(12) United States Patent
Shalitin et al.

(10) Patent No.: US 10,000,768 B2
(45) Date of Patent: Jun. 19, 2018

(54) COMPOSITIONS AND METHODS FOR INCREASING NEMATODE RESISTANCE IN PLANTS

(71) Applicants: Syngenta Participations AG, Basel (CH); Evogene Ltd., Rechovot (IL)

(72) Inventors: Dror Shalitin, RaAnana (IL); Hagai Karchi, Moshav Sitriya (IL); Xiang Huang, Durham, NC (US)

(73) Assignees: Syngenta Participations AG, Basel (CH); Evogene Ltd., Rehovot (IL)

( * ) Notice: Subject to any disclaimer, the term of this patent is extended or adjusted under 35 U.S.C. 154(b) by 1065 days.

(21) Appl. No.: 14/359,045

(22) PCT Filed: Nov. 20, 2012

(86) PCT No.: PCT/US2012/065959
§ 371 (c)(1),
(2) Date: May 16, 2014

(87) PCT Pub. No.: WO2013/078153
PCT Pub. Date: May 30, 2013

(65) Prior Publication Data
US 2014/0325696 A1 Oct. 30, 2014

Related U.S. Application Data

(60) Provisional application No. 61/562,060, filed on Nov. 21, 2011, provisional application No. 61/684,234, filed on Aug. 17, 2012.

(51) Int. Cl.
*C12N 15/82* (2006.01)
*A01H 5/10* (2018.01)

(52) U.S. Cl.
CPC ............ *C12N 15/8285* (2013.01); *A01H 5/10* (2013.01)

(58) Field of Classification Search
CPC ............ C12N 15/8285; C12N 15/8286; C12N 15/8287; A01H 5/10
See application file for complete search history.

(56) References Cited

U.S. PATENT DOCUMENTS

| | | |
|---|---|---|
| 6,084,153 A | 7/2000 | Good et al. |
| 2002/0046419 A1 | 4/2002 | Choo et al. |
| 2005/0091713 A1 | 4/2005 | Atkinson et al. |
| 2005/0108791 A1 | 5/2005 | Edgerton |
| 2006/0179511 A1 | 8/2006 | Chomet et al. |
| 2009/0012029 A1 | 1/2009 | Hussey et al. |
| 2009/0093620 A1* | 4/2009 | Kovalic .......... C07K 14/415 536/23.1 |
| 2010/0180352 A1 | 7/2010 | Ren et al. |
| 2011/0214199 A1* | 9/2011 | Coffin .............. C12N 15/1079 800/275 |
| 2011/0247096 A1* | 10/2011 | McCaig ........... C12N 15/8227 800/279 |

FOREIGN PATENT DOCUMENTS

| | | |
|---|---|---|
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/121956 | 10/2010 |
| WO | WO2010/121956 A1 | 10/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Lin, Jingyu, et al. "Transgenic soybean overexpressing GmSAMT1 exhibits resistance to multiple-HG types of soybean cyst nematode Heterodera glycines." Plant biotechnology journal 14.11 (2016): 2100-2109.*

Friedberg, Iddo. "Automated protein function prediction—the genomic challenge." Briefings in bioinformatics 7.3 (2006): 225-242.*

(Continued)

*Primary Examiner* — Lee A Visone
*Assistant Examiner* — Weihua Fan

(57) ABSTRACT

The invention relates to methods and compositions for increasing resistance or tolerance to a nematode plant pest in a plant or part thereof. Nucleotide sequences that confer resistance or tolerance to nematode plant pests when expressed in a plant are provided as well as compositions comprising the polypeptides encoded by the nucleotide sequences, and transgenic plants and parts thereof comprising the nucleotide sequences.

32 Claims, 7 Drawing Sheets

(56) References Cited

OTHER PUBLICATIONS

Spencer, T. Michael, et al. "Segregation of transgenes in maize." Plant Molecular Biology 18.2 (1992): 201-210.*
Gryson, Nicolas, et al. "Detection of DNA during the refining of soybean oil." Journal of the American Oil Chemists' Society 79.2 (2002): 171-174.*
El-Habbak, Mohamed. Overexpression/silencing of selected soybean genes alters resistance to pathogens. University of Kentucky, 2013.*
Vercauteren et al. "*Arabidopsis thaliana* Genes Expressed in the Early Compatible Interaction with Root-Knot Nematodes" *The American Phytopathological Society*, 2001, vol. 14, No. 3, pp. 288-299.
International Preliminary Report on Patentabiiity, Corresponding to International Application No. PCT/US2012/065959; dated Jun. 5, 2014, 13 pages.
Vercauteren et al. 'Arabidopsis thaliana Genes Expressed in the Early Compatible Interaction with Root-Knot Nematodes.' MPMI vol. 14, No. 3, 2001, pp. 288-299.
International Search Report and the Written Opinion Corresponding to International Application No. PCT/US2012/065959; dated Apr. 24, 2013; 18 Pages.
Klink et al. 'Microarray Detection Call Methodology as a Means to Identify and Compare Transcripts Expressed within Syncytial Cells from Soybean (*Glycin max*) Roots Undergoing Resistant and Susceptible Reactions to the Soybean Cyst Nematode (*Heterodera glycines*).' Journal of Biomedicine and Biotechnology. vol. 2010, Article ID 491217, 30 pages. 2010.
Notification of Office Action dated Feb. 24, 2017 From the State Intellectual Property Office of the People's Republic of China Re. Application No. 201280057183.X and Its Translation Into English. (10 Pages).
Notification of Office Action dated Aug. 15, 2016 From the State Intellectual Property Office of the People's Republic of China Re. Application No. 201280057183.X and Its Translation Into English.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Decision of Rejection dated Mar. 10, 2015 From the Superintendencia de Industria y Comercio de Colombia Re. Application No. 14-108302-6 and Its Translation Into English.
International Preliminary Report on Patentability dated Jun. 5, 2014 From the International Bureau of WIPO Re. Application No. PCT/US2012/065959.
International Search Report and the Written Opinion dated Apr. 24, 2013 From the International Searching Authority Re. Application No. PCT/US2012/065959.
Invitation to Pay Additional Fees dated Jan. 16, 2013 From the International Searching Authority Re. Application No. PCT/US2012/065959.
Notification of Office Action dated Dec. 14, 2015 From the State Intellectual Property Office of the People's Republic of China Re. Application No. 201280057183.X and Its Translation Into English.
Request for Examination dated Nov. 12, 2014 From the ROSPATENT, Federal Government Institution, Federal Institute of Industrial Property of the Federal Service for Intellectual Property, Patents and Trademarks of the Russian Federation Re. Application No. 2014125127 and Its Summary in English.
Vercauteren et al. "*Arabidopsis thaliana* Genes Expressed in the Early Compatible Interaction With Root-Knot Nematodes", Molecular Plant-Microbe Interactions, MPMI, 14(3): 288-299, Mar. 2001. p. 289, Right Col., Para 6, p. 290, Right Col., Para 2, p. 294, Left Col., Para 3, Right Col., Paras 2-3.

* cited by examiner pQFN, pQFNc pQXNc

COMPOSITIONS AND METHODS FOR INCREASING NEMATODE RESISTANCE IN PLANTS

STATEMENT OF PRIORITY

This application is a 35 U.S.C. § 371 national phase application of International Application Serial No. PCT/US2012/065959, filed Nov. 20, 2012, which claims the benefit of U.S. Provisional Application No. 61/562,060, filed Nov. 21, 2011 and U.S. Provisional Application No. 61/684,234, filed Aug. 17, 2012, the entire contents of each of which are incorporated by reference herein.

STATEMENT REGARDING ELECTRONIC FILING OF A SEQUENCE LISTING

A Sequence Listing in ASCII text format, submitted under 37 C.F.R. § 1.821, entitled 9207-58WO_ST25.txt, 3,013,855 bytes in size, generated on Nov. 14, 2012 and filed via EFS-Web, is provided in lieu of a paper copy. This Sequence Listing is hereby incorporated herein by reference into the specification for its disclosures.

FIELD OF THE INVENTION

The invention relates to compositions and methods for control of nematode pests in plants.

BACKGROUND

Nematodes are elongated symmetrical roundworms that constitute one of the largest and most successful phyla in the animal kingdom. Many nematode species are free-living and feed on bacteria, whereas others have evolved into pests or parasites of plants and animals, including humans.

Nematode pests of plants are responsible for many billions of dollars in economic losses annually. Nematode plant pests feed on stems, buds, leaves and, in particular, on roots of more than 2,000 vegetables, fruits, and ornamental plants, causing an estimated $100-125 billion crop loss worldwide. Nematodes are present throughout the United States (US), but are mostly a problem in warm, humid areas of the south and west, as well as in sandy soils. The most economically damaging plant nematode pest genera belong to the family Heterderidae of the order Tylenchida, and include the cyst nematodes [genera *Heterodera* and *Globodera*, e.g., soybean cyst nematode (*Heterodera glycines*, SCN) and potato cyst nematodes (*G. pallida* and *G. rostochiensis*)], and the root-knot nematodes (genus *Meloidogyne*).

Root-knot nematodes infest thousands of different plant species including vegetables, fruits, and row crops. Cyst nematodes are known to infest tobacco, cereals, sugar beets, potato, rice, corn, soybeans and many other crops. *Heterodera schachtii* (BCN) principally attacks sugar beets, and *Heterodera avenae* is a pest of cereals. *Heterodera zeae* feeds on corn, and *Globodera rostochiensis* and *G. pallida* feed on potatoes. The soybean cyst nematode (SCN) is present in every soybean-producing state in the US, and causes total soybean yield losses estimated to be nearly $1 billion per year. Once SCN is present in a field, it cannot feasibly be eradicated using known methods. Although soybean is the major economic crop attacked by SCN, SCN attacks some fifty hosts in total, including field crops, vegetables, ornamentals, and weeds.

Cotton root knot nematode (RKN) is a destructive nematode, which forms galls on the roots of cotton plants. The causative agent is *Meloidogyne incognita* (Kofoid and White) Chitwood, a nematode which can infest a variety of plant species. Nutrient and water uptake are decreased in infested plants, and plants may become susceptible to pathogens, especially Fusarium wilt. Consequently, yield is decreased in plants infested with RKN. In the US alone, an estimated 10.93% of cotton yield loss in 2004 was attributed to RKN (Blasingame and Patel, *Proceedings of the Beltwide Cotton Conferences* 1:259-262 (2005). RKN is wide-spread throughout the U.S. Cotton Belt. Methods to mitigate RKN damage include rotating cotton crops with non-susceptible crops and application of costly nematicides. However, the most effective way for cotton growers to reduce yield loss and crop damage due to RKN is to grow RKN resistant cotton cultivars.

Signs of nematode damage include stunting and yellowing of leaves, as well as wilting of the plants during hot periods. However, nematodes, including SCN, can cause significant yield loss without obvious above-ground symptoms. For example, an infestation of SCN to a plant can result in dwarfed or stunted roots, decrease the number of nitrogen-fixing nodules on the roots, and/or make the roots more susceptible to attack by other soil-borne plant pests or pathogens.

In contrast to many viral and bacterial pathogens, little is known about the molecular basis of the nematode-plant interaction, limiting the available approaches useful in controlling nematodes. Chemicals useful in controlling nematode plant pests include organophosphates and carbamates, the oldest extant class of nematicides, which target acetylcholinesterase. Imidazole derivatives such as benzimidazole exert their nematicidal effects by binding tubulin. Levamisole acts as an agonist on the nicotinic acetylcholine receptor, and avermectins act as irreversible agonists at glutamate-gated chloride channels. Unfortunately, there are certain debilitating nematode infestations which are difficult, if not impossible, to eradicate with existing control measures. In addition, the currently available nematode control agents have drawbacks in terms of efficacy, expense and environmental safety. For example, methyl bromide, which is an effective pre-plant soil fumigant used to control nematodes in many high-input, high-value crops in the US, is being phased out due to environmental and human health concerns. However, because methyl bromide has provided a reliable return on investment for nematode control, many growers of high value crops may be negatively impacted if effective and economical alternatives are not identified. In addition, environmental concerns, primarily groundwater contamination, ozone depletion, and pesticide residues in food have prompted the removal of Aldicarb, DGBCP, and other toxic nematicides from the market by the US Environmental Protection Agency. Physical control measures (such as solarization and hot water treatment), biological control measures (e.g., crop rotation), and integrated approaches have been used to ameliorate the damage caused by plant nematode pests, but no single method or combination of measures is uniformly effective.

Nematode resistant germplasm and transgenic plants have also been considered as alternatives or complements to chemical control measures. For example, transgenic plants expressing a protease inhibitor shows some resistance to cyst and root-knot nematodes (Urwin et al. 1997. Plant J. 12:455-461). Use of such alternative control measures requires a greater knowledge of the nematode-plant interaction to achieve satisfactory results. Several studies have generated gene expression data suggesting that many host plant genes are up- or down-regulated in response to nematode invasion (Szakasits et al. 2009. *Plant J.* 57:771-784; Puthoff et al. 2003. *Plant J.* 33:911-921; Bethke et al. 2009. *Proc. Natl. Acad. Sci.* 106:8067-8072; Stepanova et al. 2007, *Plant Cell* 19:2169-2185 and Kilian et al. 2007. *Plant J.* 50:347-363). However, none of these studies aid the skilled person in predicting which, if any, such genes could be successfully utilized in controlling nematodes, particularly in chimeric gene constructs for deployment in a transgenic plant.

Accordingly, the invention overcomes the deficiencies in the art by providing compositions and methods comprising recombinant nucleic acid molecules and their encoded polypeptides for control of nematode pest infestations in plants.

SUMMARY OF THE INVENTION

The needs outlined above are met by the invention which, in various embodiments, provides new compositions and methods of controlling economically important nematode pests. In particular, transgenic plants and/or plant parts expressing at least one recombinant nucleic acid molecule of the invention which modulates expression of proteins of the invention are found to reduce the ability of nematode pests to survive, grow and reproduce, or of limiting nematode-related damage or loss to the transgenic plants. The invention is also drawn to transgenic nematode-resistant plants which overexpress or have reduced expression of a protein of the invention in the transgenic plant and to methods of using the transgenic plants alone or in combination with other nematode control measures to confer maximal nematode control efficiency with reduced environmental impact. Transgenic plants and plant parts that have a protein of the invention overexpressed or inhibited (e.g., reduced amount and/or reduced activity, and the like, as compared to a control) are more tolerant or resistant to nematode pest infestation. For example, the economically important nematode pest, soybean cyst nematode (*Heterodera glycines*) can be controlled by transgenic soybean plants which overexpress a protein of the invention or which comprise a nucleic acid molecule of the invention that reduces the expression of a protein of the invention.

In one aspect of the invention, a method of controlling a nematode plant pest is provided, the method comprising contacting the nematode pest with a transgenic plant, or part thereof, having incorporated into its genome a recombinant nucleic acid molecule that modulates the expression of one or more polypeptides having the amino acid sequence of SEQ ID NOs:29-42, SEQ ID NOs:135-209, SEQ ID NOs:243-260, SEQ ID NOs:665-1046, or any combination thereof, thereby controlling the nematode plant pest. In another aspect of the invention, the recombinant nucleic acid molecule is capable of producing a double stranded RNA comprising an antisense strand and a sense strand, wherein the antisense strand is complementary to a portion of a nucleotide sequence encoding the one or more polypeptides, the portion comprising, consisting essentially of, consisting of about 18 to about 25 consecutive nucleotides having substantial identity to any one of the nucleotide sequences of SEQ ID NOs:1-28, SEQ ID NOs:43-134, SEQ ID NOs:210-242, SEQ ID NOs:261-664, or any combination thereof.

In yet another aspect of the invention, a recombinant nucleic acid molecule is provided, the nucleic acid molecule comprising a nucleotide sequence operatively linked to a promoter that functions in a plant or plant cell, wherein the nucleotide sequence is: (a) a nucleotide sequence of any of SEQ ID NOs:1-28, SEQ ID NOs:43-134, SEQ ID NOs:210-242, SEQ ID NOs:261-664; (b) a nucleotide sequence that encodes a polypeptide comprising the amino acid sequence of any of SEQ ID NOs:29-42, SEQ ID NOs:135-209, SEQ ID NOs:243-260, SEQ ID NOs:665-1046; (c) a nucleotide sequence having at least 70% sequence identity to a nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e).

In another aspect of the invention, a polypeptide is provided, the polypeptide comprising, consisting essentially of, or consisting of an amino acid sequence of any of SEQ ID NOs:29-42, SEQ ID NOs:135-209, SEQ ID NOs:243-260, SEQ ID NOs:665-1046, or any combination thereof.

In a further aspect of the invention, a method of producing a transgenic plant cell, comprising introducing into a plant cell a recombinant nucleic acid molecule is provided, the recombinant nucleic acid molecule comprising a nucleotide sequence operatively linked to a promoter that functions in a plant or plant cell, wherein the nucleotide sequence is: (a) a nucleotide sequence of any of SEQ ID NOs:1-28, SEQ ID NOs:43-134, SEQ ID NOs:210-242, SEQ ID NOs:261-644; (b) a nucleotide sequence that encodes a polypeptide comprising the amino acid sequence of any one of the amino acid sequences of SEQ ID NOs:29-42, SEQ ID NOs:135-209, SEQ ID NOs:243-260, SEQ ID NOs:665-1046; (c) a nucleotide sequence having at least 70% sequence identity to a nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e), thereby producing a transgenic plant cell that can regenerate a plant having increased resistance to a nematode plant pest.

A still further aspect of this invention provides a method of producing a soybean plant having increased resistance to infestation by a nematode plant pest, the method comprising the steps of (a) crossing the transgenic plant of the invention with itself or another plant to produce seed comprising the nucleic acid molecule of this invention, or the vector of the invention; (b) growing a progeny plant from said seed to produce a plant having increased resistance to infestation by nematode plant pests.

In additional aspects of the invention, transgenic plant cells, transgenic plants and parts thereof comprising a nucleic acid molecule that comprises one or more of the nucleotide sequences of the invention are provided and methods of using the same to control, suppress, and/or reduce infectivity of a nematode plant pest. Further provided are polypeptides of the invention and methods of using the same to control, suppress, and/or reduce the infectivity, infestation and/or cyst development of a nematode plant pest, comprising contacting a nematode plant pest with an effective amount of the polypeptide(s). In some embodiments, contacting the nematode plant pest with an effective amount of a polypeptide comprises contacting the nematode plant pest with a transgenic plant comprising a nucleic acid molecule of the invention.

The invention additionally provides a crop comprising a plurality of the transgenic plants of the invention planted together in an agricultural field. In some aspects, the invention provides a method of improving the yield of a plant crop contacted with a nematode plant pest, the method comprising cultivating a plurality of plants comprising a nucleic acid molecule of the invention as the plant crop, wherein the plurality of plants of said plant crop have increased resistance to nematode infection, thereby improving the yield of said plant crop.

The invention further provides a method of improving yield in a crop contacted with a nematode plant pest, the method comprising contacting the nematode plant pest with an effective amount of the polypeptide of the invention or the nematicidal composition of the invention, wherein the yield of the crop is improved.

These and other aspects of the invention are set forth in more detail in the description of the invention below.

BRIEF DESCRIPTION OF THE SEQUENCES IN THE SEQUENCE LISTING

Figure 1:
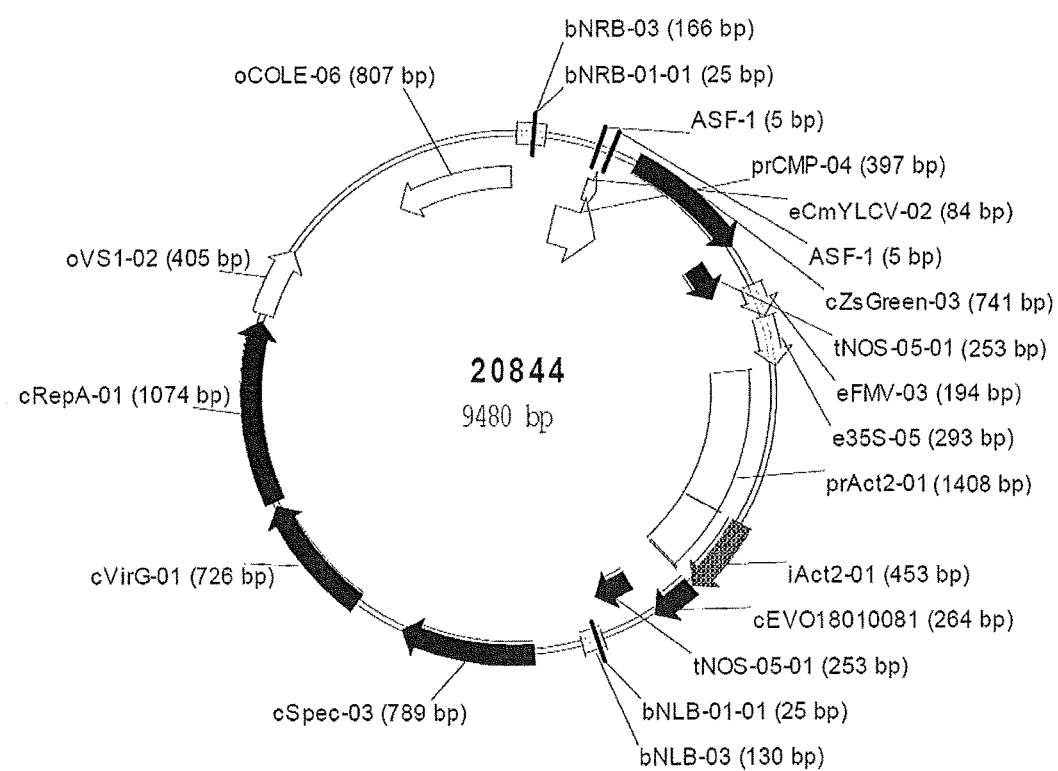
FIG. 1 is a binary vector useful for transforming plants and/or plant cells with a recombinant nucleic acid molecule of the invention.

SEQ ID NOs:1-14 are nucleotide sequences of the invention comprising untranslated regions and coding regions.

SEQ ID NOs:15-28 are coding sequences of the invention encoding the amino acid sequences of SEQ ID NOs:29-42.

SEQ ID NOs:29-42 are amino acid sequences of proteins of the invention that when overexpressed or inhibited in transgenic plants confer tolerance or resistance to nematodes.

SEQ ID NOs:43-134 are nucleotide sequences that encode the amino acid sequences of SEQ ID NOs:29-42, 135-209.

SEQ ID NOs:135-209 are amino acid sequences of homologues of SEQ ID NOs:29-42.

SEQ ID NOs: 210-223 are nucleotide sequences of the invention comprising untranslated regions and coding regions.

SEQ ID NOs:224-242 are coding sequences of the invention encoding the amino acid sequences of SEQ ID NOs: 243-260.

SEQ ID NOs: 243-260 are amino acid sequences of proteins of the invention that when overexpressed or reduced in amount or activity in transgenic plants confer tolerance or resistance to nematodes.

SEQ ID NOs:261-664 are nucleotide sequences of the invention encoding homologues of the SEQ ID NOs:210-242.

SEQ ID NOs:665-1046 are amino acid sequences of proteins of the invention that when overexpressed or reduced in amount or activity in transgenic plants confer tolerance or resistance to nematodes.

DETAILED DESCRIPTION OF THE INVENTION

This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications and patent applications mentioned in this specification are indicative of the level of skill of those skilled in the art that this invention pertains. Further, publications, patent applications, patents, and other references mentioned herein are incorporated by reference in their entirety.

As used in the description of the embodiments of the invention and the appended claims, the singular forms "a," "an," and "the" are intended to include the plural forms as well, unless the context clearly indicates otherwise.

As used herein, "and/or" refers to and encompasses any and all possible combinations of one or more of the associated listed items.

The term "about," as used herein when referring to a measurable value such as an amount of a compound, dose, time, temperature, and the like, is meant to encompass variations of 20%, 10%, 5%, 1%, 0.5%, or even 0.1% of the specified amount.

The terms "comprise," "comprises" and/or "comprising," when used in this specification, specify the presence of stated features, integers, steps, operations, elements, and/or components, but do not preclude the presence or addition of one or more other features, integers, steps, operations, elements, components, and/or groups thereof.

As used herein, the transitional phrase "consisting essentially of (and grammatical variants) means that the scope of a claim is to be interpreted to encompass the specified materials or steps recited in the claim and those that do not materially alter the basic and novel characteristic(s)" of the claimed invention. Thus, the term "consisting essentially of" when used in a claim of this invention is not intended to be interpreted to be equivalent to "comprising."

The invention is directed in part to the discovery that modulating expression by over expressing or reducing expression in a plant of at least one polypeptide described herein can result in the plant having increased resistance to nematode pests. The term "modulating" or "modulates" in the context of the invention means an alteration in the expression of a protein of the invention by over-expressing the protein or reducing the expression of the protein. Therefore, in one embodiment, the invention encompasses a method of controlling a nematode plant pest comprising contacting the nematode pest with a transgenic plant, or part thereof, having incorporated into its genome a recombinant nucleic acid molecule that modulates the expression of one or more polypeptides having any one of the amino acid sequences of SEQ ID NOs:29-42, SEQ ID NOs:135-209, SEQ ID NOs:243-260, SEQ ID NOs:665-1046, or any combination thereof, thereby controlling the nematode plant pest. In another embodiment, the recombinant nucleic molecule comprises a nucleotide sequence operatively linked to a promoter that functions in a plant or plant cell, wherein the nucleotide sequence comprises, consists essentially of, or consists of: (a) a nucleotide sequence of any one of SEQ ID NOs:1-28, SEQ ID NOs:43-134, SEQ ID NOs:210-242, SEQ ID NOs:261-644; (b) a nucleotide sequence that encodes a polypeptide comprising an amino acid sequence of any one of SEQ ID NOs:29-42, SEQ ID NOs:135-209, SEQ ID NOs:243-260, SEQ ID NOs:665-1046; (c) a nucleotide sequence having at least 70% sequence identity to the nucleotide sequence of (a) or (b); (d) a nucleotide sequence which anneals under stringent hybridization conditions to the nucleotide sequence of (a), (b) or (c), or a complement thereof; (e) a nucleotide sequence that differs from the nucleotide sequences of (a), (b), (c) or (d) above due to the degeneracy of the genetic code; and (f) any combination of the nucleotide sequences of (a)-(e). In more particular embodiments, the nucleotide sequence can comprise, consist essentially of, or consist of: (a) a nucleotide sequence of any one of SEQ ID NOs:15, 17, 20, 22, 23, 24, 26, 226, 227, 228, 230, 232, 233; (b) a nucleotide sequence that encodes a polypeptide comprising an amino acid sequence of any one of SEQ ID NOs:29-38, 40-42, 52, 243, 244, 245, 246, 248-252, 254, 256-259; (c) a nucleotide sequence having at least 70% sequence identity to the nucleotide sequence of (a) or (b); (d) a nucleotide sequence which anneals under stringent hybridization conditions to the nucleotide sequence of (a), (b) or (c), or a complement thereof; (e) a nucleotide sequence that differs from the nucleotide sequences of (a), (b), (c) or (d) above due to the degeneracy of the genetic code; and (f) any combination of the nucleotide sequences of (a)-(e). In further embodiments, the nucleotide sequence can comprise, consist essentially of, or consist of: (a) a nucleotide sequence of any one of SEQ ID NOs: 56-63, 66-127, 389-401, 408-633, 637-642; (b) a nucleotide sequence that encodes a polypeptide comprising an amino acid sequence of any one of SEQ ID NOs: 56-63, 66-127, 389-401, 408-633, 637-642; (c) a nucleotide sequence having at least 70% sequence identity to the nucleotide sequence of (a) or (b); (d) a nucleotide sequence which anneals under stringent hybridization conditions to the nucleotide sequence of (a), (b) or (c), or a complement thereof; (e) a nucleotide sequence that differs from the nucleotide sequences of (a), (b), (c) or (d) above due to the degeneracy of the genetic code; and (f) any combination of the nucleotide sequences of (a)-(e).

In yet another embodiment, the recombinant nucleic acid molecule is capable of producing a double stranded RNA comprising an antisense strand and a sense strand, wherein the antisense strand is complementary to a portion of a nucleotide sequence encoding the one or more polypeptides, the portion comprising, consisting essentially of, consisting of about 18 to about 25 consecutive nucleotides (e.g., about 18, 19, 20, 21, 22, 23, 24, or 25 consecutive nucleotides) having substantial identity to any one of the nucleotide sequences of SEQ ID NOs:1-28, SEQ ID NOs:43-134, SEQ ID NOs:210-242, SEQ ID NOs:261-644, or any combination thereof. In still another embodiment, the recombinant nucleic acid molecule modulates the expression of the one or more polypeptides of the invention (e.g., SEQ ID NOs:29-42, SEQ ID NOs:135-209, SEQ ID NOs:243-260, SEQ ID NOs:665-1046) by causing overexpression of the one or more polypeptides in the transgenic plant. In another embodiment, the recombinant nucleic acid molecule modulates the expression of the one or more polypeptides of the invention (e.g., SEQ ID NOs:29-42, SEQ ID NOs:135-209, SEQ ID NOs:243-260, SEQ ID NOs:665-1046) by causing the reduction of or reducing the expression of the one or more polypeptides in the transgenic plant.

In another embodiment, the transgenic plant or plant part of the invention is a transgenic soybean plant, a transgenic sugar beet plant, a transgenic corn plant, a transgenic cotton plant, a transgenic canola plant, a transgenic wheat plant, a transgenic sugar cane plant, or a transgenic rice plant, or a part thereof.

In still another embodiment, the nematode pest is selected from the group consisting of: a cyst nematode (*Heterodera* spp.), a root knot nematode (*Meloidogyne* spp.), a lance nematode (*Hoplolaimus* spp.), a stunt nematode (*Tylenchorhynchus* spp.), a spiral nematode (*Helicotylenchus* spp.), a lesion nematode (*Pratylenchus* spp.), a sting nematode (*Belonoluimus* spp.), a reniform nematode (*Rotylenchulus reniformis*), a burrowing nematode (*Radopholus similis*), a ring nematode (*Criconema* spp.), and any combination thereof. In another embodiment, the nematode is a soybean cyst nematode or a sugar beet cyst nematode. Overexpression or reduced expression of a polypeptide described herein can result in the plant having increased resistance to nematode plant pests. Thus, in one aspect, the invention provides a recombinant nucleic acid molecule comprising one or more (e.g., 1, 2, 3, 4, 5, 6, 7, 8, 9, 10, 11, 12, 13, 14, 15, and the like) nucleotide sequences, each of which when expressed in a plant confer increased resistance to a nematode plant pest, wherein the one or more nucleotide sequences comprise, consist essentially of, or consist of: (a) a nucleotide sequence of any of SEQ ID NOs:1-28, SEQ ID NOs:43-134, SEQ ID NOs:210-242, SEQ ID NOs:261-644; (b) a nucleotide sequence that encodes a polypeptide comprising, consisting essentially of, or consisting of the amino acid sequence of any of SEQ ID NOs:29-42, SEQ ID NOs:135-209, SEQ ID NOs:243-260, SEQ ID NOs:665-1046; (c) a nucleotide sequence having at least 70% sequence identity to a nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e). In more particular embodiments, the nucleotide sequences can comprise, consist essentially of, or consist of: (a) a nucleotide sequence of any of SEQ ID NOs:15, 17, 20, 22, 23, 24, 26, 226, 227, 228, 230, 232, 233; (b) a nucleotide sequence that encodes a polypeptide comprising, consisting essentially of, or consisting of the amino acid sequence of any of SEQ ID NOs: 29, 31, 34, 36-38, 40, 244-246, 250, 251; (c) a nucleotide sequence having at least 70% sequence identity to a nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e). In further embodiments, the nucleotide sequences can comprise, consist essentially of, or consist of: (a) a nucleotide sequence of any of SEQ ID NOs: 56-63, 66-127, 389-401, 408-633, 637-642; (b) a nucleotide sequence that encodes a polypeptide comprising, consisting essentially of, or consisting of the amino acid sequence of any of SEQ ID NOs: 56-63, 66-127, 389-401, 408-633, 637-642; (c) a nucleotide sequence having at least 70% sequence identity to a nucleotide sequence of (a) and (b) above; (d) a nucleotide sequence which anneals under stringent hybridization conditions to the nucleotide sequence of (a), (b) or (c); (e) a nucleotide sequence that differs from the nucleotide, sequences of (a), (b), (c) or (d) above due to the degeneracy of the genetic code; or (f) any combination of the nucleotide sequences of (a)-(e).

In some embodiments, in addition to the nucleotide sequences described above, a nucleic acid molecule of the invention can comprise one or more nucleotide sequences that confer increased resistance to a nematode plant pest in a plant when expressed in the plant, the one or more nucleotide sequences comprising, consisting essentially of, or consisting of: a nucleotide sequence of any of SEQ ID NOs:1-28, SEQ ID NOs:43-134, SEQ ID NOs:210-242, SEQ ID NOs:261-644, or any combination thereof. In some particular embodiments, a nucleic acid molecule of the invention can comprise one or more nucleotide sequences that confer increased resistance to a nematode plant pest in a plant when expressed in the plant, the one or more nucleotide sequences comprising, consisting essentially of, or consisting of: a nucleotide sequence of any of SEQ ID NOs: 15, 17, 20, 22, 23, 24, 26, 226, 227, 228, 230, 232, 233, or any combination thereof.

Thus, in some embodiments, the invention provides a recombinant nucleic acid molecule comprising one or more nucleotide sequences, wherein the one or more nucleotide sequences comprise, consist essentially of, or consist of: (a) a nucleotide sequence of any of SEQ ID NOs:1-28, SEQ ID NOs:43-134, SEQ ID NOs:210-242, SEQ ID NOs:261-644; (b) a nucleotide sequence that encodes a polypeptide comprising, consisting essentially of, or consisting of the amino acid sequence of any of SEQ ID NOs:29-42, SEQ ID NOs:135-209, SEQ ID NOs:243-260, SEQ ID NOs:665-1046; (c) a nucleotide sequence having significant sequence identity to a nucleotide sequence of (a), (b) above; (d) a nucleotide sequence which anneals under stringent hybridization conditions to the nucleotide sequence of (a)-(c) above; (e) a nucleotide sequence that differs from the nucleotide sequences of (a)-(d) above due to the degeneracy of the genetic code; or (f) any combination of the nucleotide sequences of (a)-(e).

In some embodiments of the invention, nucleotide sequences having significant sequence identity to the nucleotide sequences of the invention are provided. "Significant sequence identity" or "significant sequence similarity" means at least about 70%, 75%, 80%, 81%, 82%, 83%, 84%, 85%, 86%, 87%, 88%, 89%, 90%, 91%, 92%, 93%, 94%, 95%, 96%, 97%, 98%, 99%, and/or 100% identity or similarity with another nucleotide sequence. Thus, in additional embodiments, "significant sequence identity" or "significant sequence similarity" means a range of about 70% to about 100%, about 75% to about 100%, about 80% to about 100%, about 81% to about 100%, about 82% to about 100%, about 83% to about 100%, about 84% to about 100%, about 85% to about 100%, about 86% to about 100%, about 87% to about 100%, about 88% to about 100%, about 89% to about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, and/or about 99% to about 100% identity or similarity with another nucleotide sequence. Therefore, in some embodiments, a nucleotide sequence of the invention is a nucleotide sequence that has significant sequence identity to the nucleotide sequence of any of SEQ ID NOs:1-28, SEQ ID NOs:43-134, SEQ ID NOs:210-242, SEQ ID NOs: 261-644. In some particular embodiments, a nucleotide sequence of the invention is a nucleotide sequence that has significant sequence identity to the nucleotide sequence of any of SEQ ID NOs:15, 17, 20, 22, 23, 24, 26, 226, 227, 228, 230, 232 and/or 233.

In some embodiments of the invention, the nucleotide sequences and/or nucleic acid molecules of the invention can be expressed to produce polypeptides, each of which when produced in a plant result in increased resistance to a nematode plant pest. Thus, in other aspects of the invention, a polypeptide is provided, the polypeptide comprising, consisting essentially of, or consisting of an amino acid sequence of any of SEQ ID NOs:29-42, SEQ ID NOs:135-209, SEQ ID NOs:243-260, SEQ ID NOs:665-1046, wherein production of said polypeptide in a plant results in increased resistance to a nematode plant pest in the plant.

A still further aspect of the invention is a nematicidal composition comprising one or more polypeptides of the invention. In some embodiments, the composition comprises a polypeptide comprising, consisting essentially of, or consisting of an amino acid sequence of any of SEQ ID NOs:29-42, SEQ ID NOs:135-209, SEQ ID NOs:243-260, SEQ ID NOs:665-1046, or any combination thereof.

In some embodiments, a polypeptide of the invention comprises, consists essentially of, or consists of an amino acid sequence that is at least 70% identical, e.g., at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, and/or 100% identical to an amino acid sequence of any of SEQ ID NOs:29-42, SEQ ID NOs:135-209, SEQ ID NOs:243-260, SEQ ID NOs:665-1046.

The polypeptides of the invention can be produced in and collected from cells transformed with the nucleic acid molecules comprising the nucleotide sequences of the invention. Therefore, the polypeptides can be isolated and provided in a composition of the invention as a partially or fully purified full-length polypeptide, or as an active variant or fragment thereof, or the polypeptides can be provided as a cell extract or cell lysate from the cell or cells of an organism producing said polypeptide(s). Complete purification is not required in any case. The polypeptide, variant or fragment thereof can be at least about 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% pure (w/w), or more.

In some embodiments, a polypeptide or nucleotide sequence of the invention can be a conservatively modified variant. As used herein, "conservatively modified variant" refer to polypeptide and nucleotide sequences containing individual substitutions, deletions or additions that alter, add or delete a single amino acid or nucleotide or a small percentage of amino acids or nucleotides in the sequence, where the alteration results in the substitution of an amino acid with a chemically similar amino acid. Conservative substitution tables providing functionally similar amino acids are well known in the art.

As used herein, a conservatively modified variant of a polypeptide is biologically active and therefore possesses the desired activity of the reference polypeptide (e.g., conferring increased resistance to a nematode plant pest, reducing the growth of a nematode plant pest, reducing nematode cyst development) as described herein. The variant can result from, for example, a genetic polymorphism or human manipulation. A biologically active variant of the reference polypeptide can have at least about 40%, 45%, 50%, 55%, 60%, 65%, 70%, 75%, 80%, 85%, 90%, 91%, 92%, 93%, 94%, 95%, 96%, 97%, 98%, 99%, or more sequence identity or similarity (e.g., about 40% to about 99% or more sequence identity or similarity and any range therein) to the amino acid sequence for the reference polypeptide as determined by sequence alignment programs and parameters described elsewhere herein. An active variant can differ from the reference polypeptide sequence by as few as 1-15 amino acid residues, as few as 1-10, such as 6-10, as few as 5, as few as 4, 3, 2, or even 1 amino acid residue.

Naturally occurring variants may exist within a population. Such variants can be identified by using well-known molecular biology techniques, such as the polymerase chain reaction (PCR), and hybridization as described below. Synthetically derived nucleotide sequences, for example, sequences generated by site-directed mutagenesis or PCR-mediated mutagenesis which still encode a polypeptide of the invention, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif, where such residues are essential for protein activity.

For example, amino acid sequence variants of the reference polypeptide can be prepared by mutating the nucleotide sequence encoding the enzyme. The resulting mutants can be expressed recombinantly in plants, and screened for those that retain biological activity by assaying for activity against nematodes and plants using standard assay techniques as described herein. Methods for mutagenesis and nucleotide sequence alterations are known in the art. See, e.g., Kunkel (1985) *Proc. Natl. Acad. Sci. USA* 82:488-492; Kunkel et al. (1987) *Methods in Enzymol.* 154:367-382; and *Techniques in Molecular Biology* (Walker & Gaastra eds., MacMillan Publishing Co. 1983) and the references cited therein; as well as U.S. Pat. No. 4,873,192. Clearly, the mutations made in the DNA encoding the variant must not disrupt the reading frame and preferably will not create complimentary regions that could produce secondary mRNA structure. See, EP Patent Application Publication No. 75,444. Guidance as to appropriate amino acid substitutions that do not affect biological activity of the protein of interest may be found in the model of Dayhoff et al. (1978) *Atlas of Protein Sequence and Structure* (National Biomedical Research Foundation, Washington, D.C.), herein incorporated by reference.

The deletions, insertions and substitutions in the polypeptides described herein are not expected to produce radical changes in the characteristics of the polypeptide (e.g., the activity of the polypeptide). However, when it is difficult to predict the exact effect of the substitution, deletion or insertion in advance of doing so, one of skill in the art will appreciate that the effect can be evaluated by routine screening assays that can screen for the particular polypeptide activities of interest (e.g., conferring increased resistance to a nematode plant pest, reducing the growth of a nematode plant pest, reducing nematode cyst development).

In some embodiments, the compositions of the invention can comprise active fragments of the polypeptide. As used herein, "fragment" means a portion of the reference polypeptide that retains the polypeptide activity of conferring increased resistance to a nematode plant pest, reducing the growth of a nematode plant pest, reducing cyst development. A fragment also means a portion of a nucleic acid molecule encoding the reference polypeptide. An active fragment of the polypeptide can be prepared, for example, by isolating a portion of a polypeptide-encoding nucleic acid molecule that expresses the encoded fragment of the polypeptide (e.g., by recombinant expression in vitro), and assessing the activity of the fragment. Nucleic acid molecules encoding such fragments can be at least about 150, 200, 250, 300, 350, 400, 450, 500, 550, 600, 650, 700, 800, 900, 1,000, 1,100, 1,200, 1,300, 1,400, 1,500, 1,600, 1,700, 1,800, 1,900, or 2000 contiguous nucleotides, or up to the number of nucleotides present in a full-length polypeptide-encoding nucleic acid molecule. As such, polypeptide fragments can be at least about 50, 60, 70, 80, 90, 100, 125, 150, 175, 200, 225, 250, 275, 300, 325, 350, 375, 400, 425, 450, 475, 500, 525, 550, 525, 550, 600, 625, 650, 675, or 700 contiguous amino acid residues, or up to the total number of amino acid residues present in the full-length polypeptide.

Thus, in some embodiments, a variant or functional fragment of a polypeptide of this invention or a variant or functional fragment having substantial identity to a polypeptide sequence of this invention (e.g., SEQ ID NOs:29-42, SEQ ID NOs:135-209, SEQ ID NOs:243-260, SEQ ID NOs:665-1046) when produced in a transgenic plant reduces the ability of nematode pests to survive, grow and reproduce in/on or around the transgenic plant, or reduces nematode-related damage or loss to the transgenic plants producing said polypeptides.

In some embodiments, the nematicidal composition further comprises an agriculturally acceptable carrier. As used herein an "agriculturally-acceptable carrier" can include natural, synthetic, organic and/or inorganic material which is combined with the active component to facilitate its application to the plant, or part thereof. An agriculturally-acceptable carrier includes, but is not limited to, inert components, dispersants, surfactants, adjuvants, tackifiers, stickers, binders, or combinations thereof, that can be used in agricultural formulations. In other embodiments, as agriculturally acceptable carrier can be a transgenic plant or plant part.

In some embodiments, the nematicidal composition can further comprise one or more additional nematicidal and/or insecticidal compounds. Such nematicidal compounds include, without limitation, chloropicrin, metam sodium, metam potassium, dazomet, iodomethane, dimethyl disulfide (DMDS), sulfryl fluoride, oxamyl and fosthiazate.

In other embodiments, the nematicidal composition can further comprise polypeptides having insecticidal activity. Such insecticidal polypeptides include, without limitation, crystal (Cry) endotoxins from *Bacillus thuringiensis* and vegetative insecticidal proteins (VIPs) from *Bacillus* sp.

The polypeptides and compositions thereof of the invention can be applied to the surface of a plant or plant part, including but not limited to, seed, leaves, flowers, stems, tubers, roots, and the like. In some embodiments, the polypeptides and compositions of the invention are delivered orally to a nematode, wherein the nematode ingests one or more parts of a plant to which a composition comprising the polypeptides of the invention has been applied. Applying the compositions of the invention to a plant can be done using any method known to those of skill in the art for applying compounds, compositions, formulations and the like to plant surfaces. Some non-limiting examples of applying include spraying, dusting, sprinkling, scattering, misting, atomizing, broadcasting, soaking, soil injection, soil incorporation, drenching (e.g., root, soil treatment), dipping, pouring, coating, leaf or stem infiltration, side dressing or seed treatment, and the like, and combinations thereof. These and other procedures for applying a compound(s), composition(s) or formulation(s) to a plant or part thereof are well-known to those of skill in the art. In some embodiments, the polypeptides are delivered orally to a nematode in the form of a transgenic plant comprising one or more nucleotide sequences encoding one or more polypeptides of the invention.

As used herein, the terms "express," "expresses," "expressed" or "expression," and the like, with respect to a nucleic acid molecule and/or a nucleotide sequence (e.g., RNA or DNA) indicates that the nucleic acid molecule and/or a nucleotide sequence is transcribed and, optionally, translated. Thus, a nucleic acid molecule and/or a nucleotide sequence may express a polypeptide of interest or a functional untranslated RNA.

A "heterologous" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

Also as used herein, the terms "nucleic acid," "nucleic acid molecule," "nucleotide sequence" and "polynucleotide" can be used interchangeably and encompass both RNA and DNA, including cDNA, genomic DNA, mRNA, synthetic (e.g., chemically synthesized) DNA or RNA and chimeras of RNA and DNA. The term polynucleotide, nucleotide sequence, or nucleic acid refers to a chain of nucleotides without regard to length of the chain. The nucleic acid can be double-stranded or single-stranded. Where single-stranded, the nucleic acid can be a sense strand or an antisense strand. The nucleic acid can be synthesized using oligonucleotide analogs or derivatives (e.g., inosine or phosphorothioate nucleotides). Such oligonucleotides can be used, for example, to prepare nucleic acids that have altered base-pairing abilities or increased resistance to nucleases. The present invention further provides a nucleic acid that is the complement (which can be either a full complement or a partial complement) of a nucleic acid, nucleotide sequence, or polynucleotide of this invention. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25.

The term "antisense nucleotide sequence" or "antisense oligonucleotide" as used herein, refers to a nucleotide sequence that is complementary to a specified DNA or RNA sequence. Antisense oligonucleotides and nucleic acids that express the same can be made in accordance with conventional techniques. See, e.g., U.S. Pat. No. 5,023,243 to Tullis; U.S. Pat. No. 5,149,797 to Pederson et al. The antisense nucleotide sequence can be complementary to the entire nucleotide sequence encoding the polypeptide or a portion thereof of at least 10, 20, 40, 50, 75, 100, 150, 200, 300, or 500 contiguous bases and will reduce the level of polypeptide production.

Those skilled in the art will appreciate that it is not necessary that the antisense nucleotide sequence be fully complementary to the target sequence as long as the degree of sequence similarity is sufficient for the antisense nucleotide sequence to hybridize to its target and reduce production of the polypeptide or transcript. As is known in the art, a higher degree of sequence similarity is generally required for short antisense nucleotide sequences, whereas a greater degree of mismatched bases will be tolerated by longer antisense nucleotide sequences.

For example, hybridization of such nucleotide sequences can be carried out under conditions of reduced stringency, medium stringency or even stringent conditions (e.g., conditions represented by a wash stringency of 35-40% formamide with 5×Denhardt's solution, 0.5% SDS and 1×SSPE at 37° C.; conditions represented by a wash stringency of 40-45% formamide with 5×Denhardt's solution, 0.5% SDS, and 1×SSPE at 42° C.; and/or conditions represented by a wash stringency of 50% formamide with 5×Denhardt's solution, 0.5% SDS and 1×SSPE at 42° C., respectively) to the nucleotide sequences specifically disclosed herein. See, e.g., Sambrook et al., Molecular Cloning: A Laboratory Manual 2nd Ed. (Cold Spring Harbor, N.Y., 1989).

In other embodiments, antisense nucleotide sequences of the invention have at least about 70%, 80%, 90%, 95%, 97%, 98% or higher sequence similarity with the complement of the coding sequences specifically disclosed herein and will reduce the level of polypeptide production.

In other embodiments, the antisense nucleotide sequence can be directed against any coding sequence, the silencing of which results in a modulation of a polypeptide of this invention (e.g., SEQ ID NOs:29-42, 135-209, 243-260, and/or 665-1046).

The length of the antisense nucleotide sequence (i.e., the number of nucleotides therein) is not critical as long as it binds selectively to the intended location and reduces transcription and/or translation of the target sequence, and can be determined in accordance with routine procedures. In general, the antisense nucleotide sequence will be from about eight, ten or twelve nucleotides in length to about 20, 30, 50, 75, 100, 200, 300, 400 nucleotides, or longer, in length.

An antisense nucleotide sequence can be constructed using chemical synthesis and enzymatic ligation reactions by procedures known in the art. For example, an antisense nucleotide sequence can be chemically synthesized using naturally occurring nucleotides or various modified nucleotides designed to increase the biological stability of the molecules or to increase the physical stability of the duplex formed between the antisense and sense nucleotide sequences, e.g., phosphorothioate derivatives and acridine substituted nucleotides can be used. Examples of modified nucleotides which can be used to generate the antisense nucleotide sequence include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomet-hyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopenten-yladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleotide sequence can be produced using an expression vector into which a nucleic acid has been cloned in an antisense orientation (i.e., RNA transcribed from the inserted nucleic acid will be of an antisense orientation to a target nucleic acid of interest).

The antisense nucleotide sequences of the invention further include nucleotide sequences wherein at least one, or all, of the internucleotide bridging phosphate residues are modified phosphates, such as methyl phosphonates, methyl phosphonothioates, phosphoromorpholidates, phosphoropiperazidates and phosphoramidates. For example, every other one of the internucleotide bridging phosphate residues can be modified as described. In another non-limiting example, the antisense nucleotide sequence is a nucleotide sequence in which one, or all, of the nucleotides contain a 2' lower alkyl moiety (e.g., $C_1$-$C_4$, linear or branched, saturated or unsaturated alkyl, such as methyl, ethyl, ethenyl, propyl, 1-propenyl, 2-propenyl, and isopropyl). For example, every other one of the nucleotides can be modified as described. See also, Furdon et al., *Nucleic Acids Res.* 17:9193 (1989); Agrawal et al., *Proc. Natl. Acad. Sci. USA* 87:1401 (1990); Baker et al., *Nucleic Acids Res.* 18:3537 (1990); Sproat et al., *Nucleic Acids Res.* 17:3373 (1989); Walder and Walder, *Proc. Natl. Acad. Sci. USA* 85:5011 (1988); incorporated by reference herein for their teaching of methods of making antisense molecules, including those containing modified nucleotide bases).

Triple helix base-pairing methods can also be employed to inhibit production of polypeptides of this invention (e.g., SEQ ID NOs:29-42, 135-209, 243-260, and/or 665-1046). Triple helix pairing is believed to work by inhibiting the ability of the double helix to open sufficiently for the binding of polymerases, transcription factors, or regulatory molecules. Recent therapeutic advances using triplex DNA have been described in the literature (e.g., Gee et al., (1994) In: Huber et al., Molecular and Immunologic Approaches, Futura Publishing Co., Mt. Kisco, N.Y.).

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of this invention has a significant sequence identity (e.g., 70%, 75%, 80%, 81%, 82%, 83%, 84%, 85%, 86%, 87%, 88%, 89%, 90%, 91%, 92%, 93%, 94%, 95%, 96%, 97%, 98%, 99%, and/or 100%) to the nucleotide sequences of the invention.

A homologue as described herein can be utilized with any composition or method of the invention, alone or in combination with one another and/or with one or more nucleotide sequences or polypeptide sequences of the invention. Thus, in one embodiment, the invention provides a nucleic acid molecule comprising, consisting essentially of, or consisting of one or more nucleotide sequences of the invention and/or one or more homologues of any nucleotide sequence of the invention. In a further embodiment, the invention provides polypeptide compositions comprising, consisting essentially of, or consisting of one or more of the polypeptides of this invention and/or a homologue thereof.

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993);

*Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence.

As used herein, the phrase "substantially identical," in the context of two nucleic acid molecules, nucleotide sequences or protein sequences, refers to two or more sequences or subsequences that have at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 95%, at least about 96%, at least about 97%, at least about 98%, or at least about 99% nucleotide or amino acid residue identity, when compared and aligned for maximum correspondence, as measured using one of the following sequence comparison algorithms or by visual inspection. In some embodiments of the invention, the substantial identity exists over a region of the sequences that is at least about 50 residues to about 150 residues in length. Thus, in some embodiments of the invention, the substantial identity exists over a region of the sequences that is at least about 50, about 60, about 70, about 80, about 90, about 100, about 110, about 120, about 130, about 140, about 150, or more residues in length. In some particular embodiments, the sequences are substantially identical over at least about 150 residues. In a further embodiment, the sequences are substantially identical over the entire length of the coding regions. Furthermore, in representative embodiments, substantially identical nucleotide or protein sequences perform substantially the same function (e.g., conferring increased resistance to a nematode plant pest, reducing the growth of a nematode plant pest, reducing nematode cyst development).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Two nucleotide sequences can also be considered to be substantially identical when the two sequences hybridize to each other under stringent conditions. In some representative embodiments, two nucleotide sequences considered to be substantially identical hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The following are examples of sets of hybridization/wash conditions that may be used to clone homologous nucleotide sequences that are substantially identical to reference nucleotide sequences of the invention. In one embodiment, a reference nucleotide sequence hybridizes to the "test" nucleotide sequence in 7% sodium dodecyl sulfate (SDS), 0.5 M NaPO$_4$, 1 mM EDTA at 50° C. with washing in 2×SSC, 0.1% SDS at 50° C. In another embodiment, the reference nucleotide sequence hybridizes to the "test" nucleotide sequence in 7% sodium dodecyl sulfate (SDS), 0.5 M NaPO$_4$, 1 mM EDTA at 50° C. with washing in 1×SSC, 0.1% SDS at 50° C. or in 7% sodium dodecyl sulfate (SDS), 0.5 M NaPO$_4$, 1 mM EDTA at 50° C. with washing in 0.5×SSC, 0.1% SDS at 50° C. In still further embodiments, the reference nucleotide sequence hybridizes to the "test" nucleotide sequence in 7% sodium dodecyl sulfate (SDS), 0.5 M NaPO$_4$, 1 mM EDTA at 50° C. with washing in 0.1×SSC, 0.1% SDS at 50° C., or in 7% sodium dodecyl sulfate (SDS), 0.5 M NaPO$_4$, 1 mM EDTA at 50° C. with washing in 0.1×SSC, 0.1% SDS at 65° C.

In particular embodiments, a further indication that two nucleotide sequences or two polypeptide sequences are substantially identical can be that the protein encoded by the first nucleic acid is immunologically cross reactive with, or specifically binds to, the protein encoded by the second nucleic acid. Thus, in some embodiments, a polypeptide can be substantially identical to a second polypeptide, for example, where the two polypeptides differ only by conservative substitutions.

In some embodiments, the recombinant nucleic acids molecules, nucleotide sequences and polypeptides of the invention are "isolated." An "isolated" nucleic acid molecule, an "isolated" nucleotide sequence or an "isolated" polypeptide is a nucleic acid molecule, nucleotide sequence or polypeptide that, by the hand of man, exists apart from its native environment and is therefore not a product of nature. An isolated nucleic acid molecule, nucleotide sequence or polypeptide may exist in a purified form that is at least partially separated from at least some of the other components of the naturally occurring organism or virus, for example, the cell or viral structural components or other polypeptides or nucleic acids commonly found associated with the polynucleotide. In representative embodiments, the isolated nucleic acid molecule, the isolated nucleotide sequence and/or the isolated polypeptide is at least about 1%, 5%, 10%, 20%, 30%, 40%, 50%, 60%, 70%, 80%, 90%, 95%, or more pure.

In other embodiments, an isolated nucleic acid molecule, nucleotide sequence or polypeptide may exist in a non-native environment such as, for example, a recombinant host cell. Thus, for example, with respect to nucleotide sequences, the term "isolated" means that it is separated from the chromosome and/or cell in which it naturally occurs. A polynucleotide is also isolated if it is separated from the chromosome and/or cell in which it naturally occurs in and is then inserted into a genetic context, a chromosome and/or a cell in which it does not naturally occur (e.g., a different host cell, different regulatory sequences, and/or different position in the genome than as found in nature). Accordingly, the recombinant nucleic acid molecules, nucleotide sequences and their encoded polypeptides are "isolated" in that, by the hand of man, they exist apart from their native environment and therefore are not products of nature, however, in some embodiments, they can be introduced into and exist in a recombinant host cell.

In some embodiments, the nucleotide sequences and/or nucleic acid molecules of the invention can be operatively associated with a variety of promoters for expression in host cells (e.g., plant cells). Thus, in some embodiments, the invention provides transformed host cells and transformed organisms comprising the transformed host cells, wherein the host cells and organisms are transformed with one or more nucleic acid molecules/nucleotide sequences of the invention. As used herein, "operatively associated with," when referring to a first nucleic acid sequence that is operatively linked to a second nucleic acid sequence, means a situation when the first nucleic acid sequence is placed in a functional relationship with the second nucleic acid sequence. For instance, a promoter is operatively associated with a coding sequence if the promoter effects the transcription or expression of the coding sequence.

A DNA "promoter" is an untranslated DNA sequence upstream of a coding region that contains the binding site for RNA polymerase and initiates transcription of the DNA. A "promoter region" can also include other elements that act as regulators of gene expression. Promoters can include, for example, constitutive, inducible, temporally regulated, developmentally regulated, chemically regulated, tissue-preferred and tissue-specific promoters for use in the preparation of recombinant nucleic acid molecules, i.e., chimeric genes. In particular aspects, a "promoter" useful with the invention is a promoter capable of initiating transcription of a nucleotide sequence in a cell of a plant.

A "chimeric gene" is a recombinant nucleic acid molecule in which a promoter or other regulatory nucleotide sequence is operatively associated with a nucleotide sequence that codes for an mRNA or which is expressed as a protein, such that the regulatory nucleotide sequence is able to regulate transcription or expression of the associated nucleotide sequence. The regulatory nucleotide sequence of the chimeric gene is not normally operatively linked to the associated nucleotide sequence as found in nature.

The choice of promoter will vary depending on the temporal and spatial requirements for expression, and also depending on the host cell to be transformed. Thus, for example, expression of the nucleotide sequences of the invention can be in any plant and/or plant part, (e.g., in leaves, in stalks or stems, in ears, in inflorescences (e.g. spikes, panicles, cobs, etc.), in roots, seeds and/or seedlings, and the like). In many cases, however, protection against more than one type of pest is sought, and thus expression in multiple tissues is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of the nucleotide sequences in the desired cell.

Promoters useful with the invention include, but are not limited to, those that drive expression of a nucleotide sequence constitutively, those that drive expression when induced, and those that drive expression in a tissue- or developmentally-specific manner. These various types of promoters are known in the art.

Examples of constitutive promoters include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and arabidopsis (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used. Tissue specific or preferred expression patterns include, but are not limited to, green tissue specific or preferred, root specific or preferred, stem specific or preferred, and flower specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as β-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, herein incorporated by reference in its entirety. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); EP 0 452 269 to Ciba-Geigy); the stem specific promoter described in U.S. Pat. No. 5,625,136 (to Ciba-Geigy) and which drives expression of the maize trpA gene; and the cestrum yellow leaf curling virus promoter disclosed in WO 01/73087, all incorporated by reference Additional examples of tissue-specific/tissue preferred promoters include, but are not limited to, the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology,* 37(8):1108-1115), corn light harvesting complex promoter (Bansal et al. (1992) *Proc. Natl. Acad. Sci. USA* 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: *Genetic Engineering of Plants* (Hollaender ed., Plenum Press 1983; and Poulsen et al. (1986) *Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), petunia chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) *Mol. Gen. Genet.* 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et at (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J* 10:2605-2612). In some particular embodiments, the nucleotide sequences of the invention are operatively associated with a root-preferred promoter.

Particularly useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched on at the onset of senescence, such as the SAG promoter from *Arabidopsis* (Gan et al. (1995) *Science* 270:1986-1988).

In addition, promoters functional in plastids can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

In some embodiments of the invention, inducible promoters can be used. Thus, for example, chemical-regulated promoters can be used to modulate the expression of a gene in a plant through the application of an exogenous chemical regulator. Regulation of the expression of nucleotide sequences of the invention via promoters that are chemically regulated enables the polypeptides of the invention to be synthesized only when the crop plants are treated with the inducing chemicals. Depending upon the objective, the promoter may be a chemical-inducible promoter, where application of a chemical induces gene expression, or a chemical-repressible promoter, where application of the chemical represses gene expression.

Chemical inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1 a promoter, which is activated by salicylic acid (e.g., the PR1a system), steroid steroid-responsive promoters (see, e.g., the glucocorticoid-inducible promoter in Schena et al. (1991) *Proc. Natl. Acad. Sci. USA* 88, 10421-10425 and McNellis et al. (1998) *Plant J.* 14, 247-257) and tetracycline-inducible and tetracycline-repressible promoters (see, e.g., Gatz et al. (1991) *Mol. Gen. Genet.* 227, 229-237, and U.S. Pat. Nos. 5,814,618 and 5,789,156, Lac repressor system promoters, copper-inducible system promoters, salicylate-inducible system promoters (e.g., the PR1a system), glucocorticoid-inducible promoters (Aoyama et al. (1997) *Plant J.* 11:605-612), and ecdysone-inducible system promoters.

Other non-limiting examples of inducible promoters include ABA- and turgor-inducible promoters, the auxin-binding protein gene promoter (Schwob et al. (1993) *Plant J.* 4:423-432), the UDP glucose flavonoid glycosyl-transferase promoter (Ralston et al. (1988) *Genetics* 119:185-197), the MPI proteinase inhibitor promoter (Cordero et al. (1994) *Plant J.* 6:141-150), and the glyceraldehyde-3-phosphate dehydrogenase promoter (Kohler et al. (1995) *Plant Mol. Biol.* 29:1293-1298; Martinez et al. (1989) *J. Mol, Biol.* 208:551-565; and Quigley et al. (1989) *J. Mol. Evol.* 29:412-421). Also included are the benzene sulphonamide-inducible (U.S. Pat. No. 5,364,780) and alcohol-inducible (Int'l Patent Application Publication Nos. WO 97/06269 and WO 97/06268) systems and glutathione S-transferase promoters. Likewise, one can use any of the inducible promoters described in Gatz (1996) *Current Opinion Biotechnol.* 7:168-172 and Gatz (1997) *Annu. Rev. Plant Physiol. Plant Mol. Biol.* 48:89-108. Other chemically inducible promoters useful for directing the expression of the nucleotide sequences of this invention in plants are disclosed in U.S. Pat. No. 5,614,395 herein incorporated by reference in its entirety. Chemical induction of gene expression is also detailed in the published application EP 0 332 104 (to Ciba-Geigy) and U.S. Pat. No. 5,614,395. In some embodiments, a promoter for chemical induction can be the tobacco PR-1a promoter.

In further aspects, the nucleotide sequences of the invention can be operatively associated with a promoter that is wound inducible or inducible by pest or pathogen infection (e.g., a nematode plant pest). Numerous promoters have been described which are expressed at wound sites and/or at the sites of pest attack (e.g., insect/nematode feeding) or phytopathogen infection. Ideally, such a promoter should be active only locally at or adjacent to the sites of attack, and in this way expression of the nucleotide sequences of the invention will be focused in the cells that are being invaded. Such promoters include, but are not limited to, those described by Stanford et al., *Mol. Gen. Genet.* 215:200-208 (1989), Xu et al. *Plant Molec. Biol.* 22:573-588 (1993), Logemann et al. *Plant Cell* 1:151-158 (1989), Rohrmeier and Lehle, *Plant Molec. Biol.* 22:783-792 (1993), Firek et al. *Plant Molec. Biol.* 22:129-142 (1993), Warner et al. *Plant J.* 3:191-201 (1993), U.S. Pat. Nos. 5,750,386, 5,955,646, 6,262,344, 6,395,963, 6,703,541, 7,078,589, 7,196,247, 7,223,901, and U.S. Patent Application Publication 2010043102.

As used herein, "expression cassette" means a nucleic acid molecule comprising a nucleotide sequence of interest (e.g., the nucleotide sequences of the invention), wherein said nucleotide sequence is operatively associated with at least a control sequence (e.g., a promoter). Thus, some embodiments of the invention provide expression cassettes designed to express the nucleotides sequences of the invention. In this manner, for example, one or more plant promoters operatively associated with one or more nucleotide sequences of the invention (e.g., SEQ ID NOs:1-28, SEQ ID NOs:43-134, SEQ ID NOs:210-242, SEQ ID NOs:261-644) are provided in expression cassettes for expression in an organism or cell thereof (e.g., a plant, plant part and/or plant cell).

An expression cassette comprising a nucleotide sequence of interest may be chimeric, meaning that at least one of its components is heterologous with respect to at least one of its other components. An expression cassette may also be one that is naturally occurring but has been obtained in a recombinant form useful for heterologous expression. Typically, however, the expression cassette is heterologous with respect to the host, i.e., the particular nucleic acid sequence of the expression cassette does not occur naturally in the host cell and must have been introduced into the host cell or an ancestor of the host cell by a transformation event.

In addition to the promoters operatively linked to the nucleotide sequences of the invention, an expression cassette of the invention can also include other regulatory sequences. As used herein, "regulatory sequences" means nucleotide sequences located upstream (5' non-coding sequences), within or downstream (3' non-coding sequences) of a coding sequence, and which influence the transcription, RNA processing or stability, or translation of the associated coding sequence. Regulatory sequences include, but are not limited to, promoters, enhancers, introns, translation leader sequences, termination signals, and polyadenylation signal sequences.

For purposes of the invention, the regulatory sequences or regions can be native/analogous to the plant, plant part and/or plant cell and/or the regulatory sequences can be native/analogous to the other regulatory sequences. Alternatively, the regulatory sequences may be heterologous to the plant (and/or plant part and/or plant cell) and/or to each other (i.e., the regulatory sequences). Thus, for example, a promoter can be heterologous when it is operatively linked to a polynucleotide from a species different from the species from which the polynucleotide was derived. Alternatively, a promoter can also be heterologous to a selected nucleotide sequence if the promoter is from the same/analogous species from which the polynucleotide is derived, but one or both (i.e., promoter and/or polynucleotide) are substantially modified from their original form and/or genomic locus, and/or the promoter is not the native promoter for the operably linked polynucleotide.

A number of non-translated leader sequences derived from viruses are known to enhance gene expression. Specifically, leader sequences from Tobacco Mosaic Virus (TMV, the "ω-sequence"), Maize Chlorotic Mottle Virus (MCMV) and Alfalfa Mosaic Virus (AMV) have been shown to be effective in enhancing expression (Gallie et al. (1987) *Nucleic Acids Res.* 15:8693-8711; and Skuzeski et al. (1990) *Plant Mol. Biol.* 15:65-79). Other leader sequences known in the art include, but are not limited to, picornavirus leaders such as an encephalomyocarditis (EMCV) 5' non-coding region leader (Elroy-Stein et al. (1989) *Proc. Natl. Acad. Sci. USA* 86:6126-6130); potyvirus leaders such as a Tobacco Etch Virus (TEV) leader (Allison et al. (1986) *Virology* 154:9-20); Maize Dwarf Mosaic Virus (MDMV) leader (Allison et al. (1986), supra); human immunoglobulin heavy-chain binding protein (BiP) leader (Macejak & Samow (1991) *Nature* 353:90-94); untranslated leader from the coat protein mRNA of AMV (AMV RNA 4; Jobling & Gehrke (1987) *Nature* 325:622-625); tobacco mosaic TMV leader (Gallie et al. (1989) *Molecular Biology of RNA* 237-256); and MCMV leader (Lommel et al. (1991) *Virology* 81:382-385). See also, Della-Cioppa et al. (1987) *Plant Physiol.* 84:965-968.

An expression cassette also can optionally include a transcriptional and/or translational termination region (i.e., termination region) that is functional in plants. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the plant host, or may be derived from another source (i.e., foreign or heterologous to the promoter, the nucleotide sequence of interest, the plant host, or any combination thereof). Appropriate transcriptional terminators include, but are not limited to, the CAMV 35S terminator, the tml terminator, the nopaline synthase terminator and/or the pea rbcs E9 terminator. These can be used in both monocotyledons and dicotyledons. In addition, a coding sequence's native transcription terminator can be used.

An expression cassette of the invention also can include a nucleotide sequence for a selectable marker, which can be used to select a transformed plant, plant part and/or plant cell. As used herein, "selectable marker" means a nucleotide sequence that when expressed imparts a distinct phenotype to the plant, plant part and/or plant cell expressing the marker and thus allows such transformed plants, plant parts and/or plant cells to be distinguished from those that do not have the marker. Such a nucleotide sequence may encode either a selectable or screenable marker, depending on whether the marker confers a trait that can be selected for by chemical means, such as by using a selective agent (e.g., an antibiotic, herbicide, or the like), or on whether the marker is simply a trait that one can identify through observation or testing, such as by screening (e.g., the R-locus trait). Of course, many examples of suitable selectable markers are known in the art and can be used in the expression cassettes described herein.

Examples of selectable markers include, but are not limited to, a nucleotide sequence encoding neo or nptII, which confers resistance to kanamycin, G418, and the like (Potrykus et al. (1985) *Mol. Gen. Genet.* 199:183-188); a nucleotide sequence encoding bar, which confers resistance to phosphinothricin; a nucleotide sequence encoding an altered 5-enolpyruvylshikimate-3-phosphate (EPSP) synthase, which confers resistance to glyphosate (Hinchee et al. (1988) *Biotech.* 6:915-922); a nucleotide sequence encoding a nitrilase such as bxn from *Klebsiella ozaenae* that confers resistance to bromoxynil (Stalker et al. (1988) *Science* 242:419-423); a nucleotide sequence encoding an altered acetolactate synthase (ALS) that confers resistance to imidazolinone, sulfonylurea or other ALS-inhibiting chemicals (EP Patent Application No. 154204); a nucleotide sequence encoding a methotrexate-resistant dihydrofolate reductase (DHFR) (Thillet et al. (1988) *J Biol. Chem.* 263:12500-12508); a nucleotide sequence encoding a dalapon dehalogenase that confers resistance to dalapon; a nucleotide sequence encoding a mannose-6-phosphate isomerase (also referred to as phosphomannose isomerase (PMI)) that confers an ability to metabolize mannose (U.S. Pat. Nos. 5,767,378 and 5,994,629); a nucleotide sequence encoding an altered anthranilate synthase that confers resistance to 5-methyl tryptophan; and/or a nucleotide sequence encoding hph that confers resistance to hygromycin. One of skill in the art is capable of choosing a suitable selectable marker for use in an expression cassette of the invention.

Additional selectable markers include, but are not limited to, a nucleotide sequence encoding β-glucuronidase or uidA (GUS) that encodes an enzyme for which various chromogenic substrates are known; an R-locus nucleotide sequence that encodes a product that regulates the production of anthocyanin pigments (red color) in plant tissues (Dellaporta et al., "Molecular cloning of the maize R-nj allele by transposon-tagging with Ac," pp. 263-282 In: *Chromosome Structure and Function: Impact of New Concepts,* 18th Stadler Genetics Symposium (Gustafson & Appels eds., Plenum Press 1988)); a nucleotide sequence encoding β-lactamase, an enzyme for which various chromogenic substrates are known (e.g., PADAC, a chromogenic cephalosporin) (Sutcliffe (1978) *Proc. Natl. Acad. Sci. USA* 75:3737-3741); a nucleotide sequence encoding xylE that encodes a catechol dioxygenase (Zukowsky et al. (1983) *Proc. Natl. Acad. Sci. USA* 80:1101-1105); a nucleotide sequence encoding tyrosinase, an enzyme capable of oxidizing tyrosine to DOPA and dopaquinone, which in turn condenses to form melanin (Katz et al. (1983) *J Gen. Microbiol.* 129:2703-2714); a nucleotide sequence encoding β-galactosidase, an enzyme for which there are chromogenic substrates; a nucleotide sequence encoding luciferase (lux) that allows for bioluminescence detection (Ow et al. (1986) *Science* 234:856-859); a nucleotide sequence encoding aequorin, which may be employed in calcium-sensitive bioluminescence detection (Prasher et al. (1985) *Biochem. Biophys. Res. Comm.* 126:1259-1268); or a nucleotide sequence encoding green fluorescent protein (Niedz et al. (1995) *Plant Cell Reports* 14:403-406). One of skill in the art is capable of choosing a suitable selectable marker for use in an expression cassette of the invention.

An expression cassette of the invention also can include nucleotide sequences that encode other desired traits. Such desired traits can be other nucleotide sequences which confer nematode resistance, insect resistance, or which confer other agriculturally desirable traits. Such nucleotide sequences can be stacked with any combination of nucleotide sequences to create plants, plant parts or plant cells having the desired phenotype. Stacked combinations can be created by any method including, but not limited to, cross breeding plants by any conventional methodology, or by genetic transformation. If stacked by genetically transforming the plants, nucleotide sequences encoding additional desired traits can be combined at any time and in any order. For example, a transgenic plant comprising one or more desired traits can be used as the target to introduce further traits by subsequent transformation. The additional nucleotide sequences can be introduced simultaneously in a co-transformation protocol with a nucleotide sequence, nucleic acid molecule, nucleic acid construct, and/or composition of the invention, provided by any combination of expression cassettes. For example, if two nucleotide sequences will be introduced, they can be incorporated in separate cassettes (trans) or can be incorporated on the same cassette (cis). Expression of the nucleotide sequences can be driven by the same promoter or by different promoters. It is further recognized that nucleotide sequences can be stacked at a desired genomic location using a site-specific recombination system. See, e.g., Int'l Patent Application Publication Nos. WO 99/25821; WO 99/25854; WO 99/25840; WO 99/25855 and WO 99/25853.

Thus, an expression cassette can include a coding sequence for one or more polypeptides for agronomic traits that primarily are of benefit to a seed company, grower or grain processor. A polypeptide of interest can be any polypeptide encoded by a nucleotide sequence of interest. Non-limiting examples of polypeptides of interest that are suitable for production in plants include those resulting in agronomically important traits such as herbicide resistance (also sometimes referred to as "herbicide tolerance"), virus resistance, bacterial pathogen resistance, insect resistance, nematode resistance, and/or fungal resistance. See, e.g., U.S. Pat. Nos. 5,569,823; 5,304,730; 5,495,071; 6,329,504; and 6,337,431. Thus, in some embodiments, the expression cassette or expression vector of the invention can comprise one or more nucleotide sequences that confer insect resistance and/or additional nematode resistance.

In other embodiments, a polypeptide of interest also can be one that increases plant vigor or yield (including traits that allow a plant to grow at different temperatures, soil conditions and levels of sunlight and precipitation), or one that allows identification of a plant exhibiting a trait of interest (e.g., a selectable marker, seed coat color, etc.). Various polypeptides of interest, as well as methods for introducing these polypeptides into a plant, are described, for example, in U.S. Pat. Nos. 4,761,373; 4,769,061; 4,810,648; 4,940,835; 4,975,374; 5,013,659; 5,162,602; 5,276,268; 5,304,730; 5,495,071; 5,554,798; 5,561,236; 5,569,823; 5,767,366; 5,879,903, 5,928,937; 6,084,155; 6,329,504 and 6,337,431; as well as US Patent Publication No. 2001/0016956. See also, on the World Wide Web at lifesci.sussex.ac.uk/home/Neil_Crickmore/Bt/.

In some particular embodiments of the invention, a nucleotide sequence of interest includes, but is not limited to, RNAi (siRNA, antisense RNA) and/or miRNA known to be associated with nematode resistance, and/or nucleotide sequences coding for insect resistance including, but not limited to, nucleotide sequences coding for *Bacillus thuringiensis* (Bt) toxins, for example, the various delta-endotoxin genes such as Cry1Aa, Cry1Ab, Cry1Ac, Cry1B, Cry1C, Cry1D, Cry1Ea, Cry1Fa, Cry3A, Cry9A, Cry9C and Cry9B; as well as genes encoding vegetative insecticidal proteins such as Vip1, Vip2 and Vip3). An extensive list of Bt toxins can be found on the worldwide web at *Bacillus thuringiensis* Toxin Nomenclature Database maintained by the University of Sussex (see also, Crickmore et al. (1998) *Microbiol. Mol. Biol. Rev.* 62:807-813).

In addition to expression cassettes, the nucleic acid molecules and nucleotide sequences described herein can be used in connection with vectors. The term "vector" refers to a composition for transferring, delivering or introducing a nucleic acid (or nucleic acids) into a cell. A vector comprises a nucleic acid molecule comprising the nucleotide sequence(s) to be transferred, delivered or introduced. Vectors for use in transformation of plants and other organisms are well known in the art. Non-limiting examples of general classes of vectors include a viral vector including but not limited to an adenovirus vector, a retroviral vector, an adeno-associated viral vector, a plasmid vector, a phage vector, a phagemid vector, a cosmid, a fosmid, a bacteriophage, or an artificial chromosome. The selection of a vector will depend upon the preferred transformation technique and the target species for transformation. Accordingly, in further embodiments, a recombinant nucleic acid molecule of the invention can be comprised within a recombinant vector. The size of a vector can vary considerably depending on whether the vector comprises one or multiple expression cassettes (e.g., for molecular stacking). Thus, a vector size can range from about 3 kb to about 30 kb. Thus, in some embodiments, a vector is about 3 kb, 4 kb, 5 kb, 6 kb, 7 kb, 8 kb, 9 kb, 10 kb, 11 kb, 12 kb, 13 kb, 14 kb, 15 kb, 16 kb, 17 kb, 18 kb, 19 kb, 20 kb, 21 kb, 22 kb, 23 kb, 24 kb, 25 kb, 26 kb, 27 kb, 28 kb, 29 kb, 30 kb, or any range therein, in size. In some particular embodiments, a vector can be about 3 kb to about 10 kb in size.

In additional embodiments of the invention, a method of producing a transgenic plant cell is provided, said method comprising introducing into a plant cell a recombinant nucleic acid molecule/nucleotide sequence of the invention, thereby producing a transgenic plant cell that can regenerate a transgenic plant having increased resistance to a nematode plant pest as compared to a plant regenerated from a plant cell that does not comprise said nucleic acid molecule. In some embodiments, the transgenic plant cell comprises more than one (e.g., 2, 3, 4, 5, 6, 7, 8, 9, 10, etc.) nucleic acid molecule/nucleotide sequence of the invention. Thus, in some aspects of the invention, the transgenic plants, or parts thereof, comprise and express one or more nucleic acid molecule/nucleotide sequences of the invention, thereby producing one or more polypeptides of the invention.

In representative embodiments, a method of producing a transgenic plant cell is provided, said method comprising introducing into a plant cell a recombinant nucleic acid molecule of the invention, said recombinant nucleic acid molecule comprising a nucleotide sequence operatively linked to a promoter, which when expressed in a plant confer increased resistance to a nematode plant pest, the nucleotide sequence comprising, consisting essentially of, or consisting of: (a) a nucleotide sequence of SEQ ID NOs:1-28, SEQ ID NOs:43-134, SEQ ID NOs:210-242, SEQ ID NOs:261-644; (b) a nucleotide sequence that encodes a polypeptide comprising, consisting essentially of, or consisting of the amino acid sequence of any one of SEQ ID NOs:29-42, SEQ ID NOs:135-209, SEQ ID NOs:243-260, SEQ ID NOs:665-1046; (c) a nucleotide sequence having significant sequence identity to nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e), thereby producing a transgenic plant cell that can regenerate a plant having increased resistance to a nematode plant pest as compared to a plant regenerated from a plant cell that does not comprise said recombinant nucleic acid molecule. In further embodiments, a method of producing a transgenic plant cell is provided, said method comprising introducing into a plant cell a recombinant nucleic acid molecule of the invention, said recombinant nucleic acid molecule comprising a nucleotide sequence operatively linked to a promoter, which when expressed in a plant confer increased resistance to a nematode plant pest, the nucleotide sequence comprising, consisting essentially of, or consisting of: (a) a nucleotide sequence of SEQ ID NOs: 15, 17, 20, 22, 23, 24, 26, 226, 227,228, 230, 232 and/or 233; (b) a nucleotide sequence that encodes a polypeptide comprising, consisting essentially of, or consisting of the amino acid sequence of any one of SEQ ID NOs: 29, 31, 34, 36-38, 40, 244-246, 250, 251; (c) a nucleotide sequence having significant sequence identity to nucleotide sequence of (a) and (b) above; (d) a nucleotide sequence which anneals under stringent hybridization conditions to the nucleotide sequence of (a), (b) or (c); (e) a nucleotide sequence that differs from the nucleotide sequences of (a), (b), (c) or (d) above due to the degeneracy of the genetic code; or (f) any combination of the nucleotide sequences of (a)-(e), thereby producing a transgenic plant cell that can regenerate a plant having increased resistance to a nematode plant pest as compared to a plant regenerated from a plant cell that does not comprise said recombinant nucleic acid molecule.

Thus, in some embodiments, the invention provides a transgenic plant or part thereof that is regenerated from the transgenic plant cell of the invention, wherein the transgenic plant or plant part has increased resistance to a nematode plant pest as compared to a control plant or plant part that is regenerated from a plant cell that does not comprise said recombinant nucleic acid molecule.

The terms "increase," "increasing," "increased," "enhance," "enhanced," "enhancing," and "enhancement" (and grammatical variations thereof), as used herein, describe an increase in the resistance of a plant to a nematode plant pest (e.g., a soybean plant having increased resistance to the soybean cyst nematode) by the introduction of a recombinant nucleic acid molecule of the invention into the plant, thereby producing a transgenic plant having increased resistance to the pest. This increase in resistance can be observed by comparing the resistance of the plant transformed with the recombinant nucleic acid molecule of the invention to the resistance of a plant lacking (i.e., not transformed with) the recombinant nucleic acid molecule of the invention (i.e., a control).

As used herein, the terms "reduce," "reduced," "reducing," "reduction," "diminish," "suppress," and "decrease" (and grammatical variations thereof), describe, for example, a decrease in the growth of a nematode plant pest, a decrease in the ability of the nematode to survive, grow, feed, and/or reproduce, a decrease in the infectivity of a nematode plant pest, a decrease in the infestation of a plant by a nematode plant pest, and/or a decrease in nematode cyst development by a nematode plant pest on roots of a plant as compared to a control as described herein.

A further aspect of the invention provides transformed non-human host cells and transformed non-human organisms comprising the transformed non-human cells, wherein the transformed cells and transformed organisms comprise nucleic acid molecules comprising one or more nucleotide sequences of the invention. In some embodiments, the transformed non-human host cell includes but is not limited to a transformed bacterial cell, and/or a transformed plant cell. Thus, in some embodiments, the transformed non-human organism comprising the transformed non-human host cell includes, but is not limited to, a transformed bacterium, and/or a transformed plant.

In some particular embodiments, the invention provides a transgenic plant cell comprising a nucleic acid molecule of the invention and/or a transgenic plant regenerated from said transgenic plant cell. Accordingly, in some embodiments of the invention, a transgenic plant having increased resistance to a nematode plant pest is provided, said transgenic plant regenerated from a transgenic plant cell comprising at least one recombinant nucleic acid molecule/nucleotide sequence of the invention.

Additional aspects of the invention include a harvested product produced from the transgenic plants and/or parts thereof of the invention, as well as a processed product produced from said harvested product. A harvested product can be a whole plant or any plant part, as described herein, wherein said harvested product comprises a recombinant nucleic acid molecule/nucleotide sequence of the invention. Thus, in some embodiments, non-limiting examples of a harvested product include a seed, a fruit, a flower or part thereof (e.g., an anther, a stigma, and the like), a leaf, a stem, and the like. In other embodiments, a processed product includes, but is not limited to, a flour, meal, oil, starch, cereal, and the like produced from a harvested seed of the invention, wherein said seed comprises a recombinant nucleic acid molecule/nucleotide sequence of the invention.

Non-limiting examples of plants can include vegetable crops, including artichokes, kohlrabi, arugula, leeks, asparagus, lettuce (e.g., head, leaf, romaine), bok choy, malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy) cardoni, carrots, napa, okra, onions, celery, parsley, chick peas, parsnips, chicory, peppers, potatoes, cucurbits (e.g., marrow, cucumber, zucchini, squash, pumpkin), radishes, dry bulb onions, rutabaga, eggplant (also called brinjal), salsify, escarole, shallots, endive, garlic, spinach, green onions, squash, greens, beet (sugar beet and fodder beet), sweet potatoes, swiss chard, horseradish, tomatoes, turnips, and spices; a fruit and/or vine crop such as apples, apricots, cherries, nectarines, peaches, pears, plums, prunes, cherry, quince, almonds, chestnuts, filberts, pecans, pistachios, walnuts, citrus, blueberries, boysenberries, cranberries, currants, loganberries, raspberries, strawberries, blackberries, grapes, avocados, bananas, kiwi, persimmons, pomegranate, pineapple, tropical fruits, pomes, melon, mango, papaya, and lychee; a field crop plant such as clover, alfalfa, evening primrose, meadow foam, corn/maize (field, sweet, popcorn), hops, jojoba, peanuts, rice, safflower, small grains (barley, oats, rye, wheat, etc.), sorghum, tobacco, kapok, a leguminous plant (beans, lentils, peas, soybeans), an oil plant (rape, mustard, poppy, olive, sunflower, coconut, castor oil plant, cocoa bean, groundnut), *Arabidopsis*, a fibre plant (cotton, flax, hemp, jute), lauraceae (cinnamon, camphor), or a plant such as coffee, sugar cane, tea, and natural rubber plants; and/or a bedding plant such as a flowering plant, a cactus, a succulent and/or an ornamental plant, as well as trees such as forest (broad-leaved trees and evergreens, such as conifers), fruit, ornamental, and nut-bearing trees, as well as shrubs and other nursery stock.

In some embodiments, a plant can be any plant species or plant varieties susceptible to soybean cyst nematode infection including, but not limited to, China pinks, edible beans, lespedeza, vetch (common, hairy or winter), lupine, clover (crimson, scarlet or alsike), sweetclover, birdsfoot trefoil, crownvetch, garden pea, cowpea, black-eyed pea, soybeans (wild and cultivated), black locust, honey locust, portulaca, Bells of Ireland, common chickweed, mousear chickweed, mullein, sicklepod, *Digitalis penstemon*, pokeweed, purslane, bittercress, Rocky Mountain beeplant, spotted geranium, toadflax, winged pigweed, *Psoralea* spp., *Cleome serrulata*, vetch (American, Carolina or wood), burclover (*Medicago minima*), chick-weed (*Cerastium vulgatum*), dalea, Canadian milkvetch, hemp sesbania, borage, canary bird flower, cup flower, caraway, Chinese lantern plant, blue gem viscaria, coralbell, Margaret double carnation, *Rosa multiflora*, pink queen, geranium (*Geranium maculatum*), cup-flower, delphinium, foxglove, geum, common horehound, poppy, sage, snapdragon, beard-tongue (*Penstemon digitalis*), *Desmodium nudifolorum, D. marilandicum, D. viridiflorum*, corn cockle, sweet basil, sweetpea, verbena, henbit (*Lamium amplexicaule*), purple deadnettle (*Lamium purpureum*), (field pennycress (*Thlaspi arvense*), shepherd's-purse (*Capsella bursa-pastoris*), hop clovers, beggars weed, tick clover, corn cockle, hogpeanut, milkpea, and wildbean (*Strophostyles helvola*).

In some particular embodiments, a transgenic plant of the invention includes, but is not limited to, a transgenic soybean plant, a transgenic sugar beet plant, a transgenic corn plant, a transgenic cotton plant, a transgenic canola plant, a transgenic wheat plant, or a transgenic rice plant. In other embodiments, a transgenic plant cell of the invention includes, but is not limited to, a transgenic soybean cell, a transgenic sugar beet cell, a transgenic corn cell, a transgenic cotton cell, a transgenic canola cell, a transgenic sugar cane cell, a transgenic wheat cell, or a transgenic rice cell.

As used herein, the term "plant part" includes but is not limited to embryos, pollen, ovules, seeds, leaves, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. Further, as used herein, "plant cell" refers to a structural and physiological unit of the plant, which comprises a cell wall and also may refer to a protoplast. A plant cell of the invention can be in the form of an isolated single cell or can be a cultured cell or can be a part of a higher-organized unit such as, for example, a plant tissue or a plant organ. A "protoplast" is an isolated plant cell without a cell wall or with only parts of the cell wall. Thus, in some embodiments of the invention, a transgenic cell comprising a nucleic acid molecule and/or nucleotide sequence of the invention is a cell of any plant or plant part including, but not limited to, a root cell, a leaf cell, a tissue culture cell, a seed cell, a flower cell, a fruit cell, a pollen cell, and the like.

In some particular embodiments, the invention provides a transgenic seed produced from a transgenic plant of the invention, wherein the transgenic seed comprises a nucleic acid molecule/nucleotide sequence of the invention.

"Plant cell culture" means cultures of plant units such as, for example, protoplasts, cell culture cells, cells in plant tissues, pollen, pollen tubes, ovules, embryo sacs, zygotes and embryos at various stages of development. In some embodiments of the invention, a transgenic tissue culture or transgenic plant cell culture is provided, wherein the transgenic tissue or cell culture comprises a nucleic acid molecule/nucleotide sequence of the invention.

As used herein, a "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

The term "nematode plant pest" as used herein includes any nematode species that is a pest on a plant. Non-limiting examples of nematode pests include cyst nematodes (*Heterodera* spp.), especially the soybean cyst nematode (*Heterodera glycines*), root knot nematodes (*Meloidogyne* spp.), lance nematodes (*Hoplolaimus* spp.), stunt nematodes (*Tylenchorhynchus* spp.), spiral nematodes (*Helicotylenchus* spp.), lesion nematodes (*Pratylenchus* spp.), sting nematodes (*Belonoluimus* spp.), reniform nematodes (*Rotylenchulus reniformis*), burrowing nematodes (*Radopholus similis*), Citrus nematode (*Tylenchulus semipenetrans*), and ring nematodes (*Criconema* spp.).

"Introducing," in the context of a nucleotide sequence of interest (e.g., the nucleotide sequences and nucleic acid molecules of the invention), means presenting the nucleotide sequence of interest to the plant, plant part, and/or plant cell in such a manner that the nucleotide sequence gains access to the interior of a cell. Where more than one nucleotide sequence is to be introduced these nucleotide sequences can be assembled as part of a single polynucleotide or nucleic acid construct, or as separate polynucleotide or nucleic acid constructs, and can be located on the same or different transformation vectors. Accordingly, these polynucleotides can be introduced into plant cells in a single transformation event, in separate transformation events, or, e.g., as part of a breeding protocol. Thus, the term "transformation" as used herein refers to the introduction of a heterologous nucleic acid into a cell. Transformation of a cell may be stable or transient. Thus, in some embodiments, a plant cell of the invention is stably transformed with a nucleic acid molecule of the invention. In other embodiments, a plant of the invention is transiently transformed with a nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended the introduced polynucleotide is stably incorporated into the genome of the cell, and thus the cell is stably transformed with the polynucleotide.

"Stable transformation" or "stably transformed" as used herein means that a nucleic acid is introduced into a cell and integrates into the genome of the cell. As such, the integrated nucleic acid is capable of being inherited by the progeny thereof, more particularly, by the progeny of multiple successive generations. "Genome" as used herein also includes the nuclear and the plastid genome, and therefore includes integration of the nucleic acid into, for example, the chloroplast genome. Stable transformation as used herein can also refer to a transgene that is maintained extrachromosomally, for example, as a minichromosome.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a plant or other organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

A nucleic acid of the invention (e.g., one or more of the nucleotide sequences of SEQ ID NOs:1-28, SEQ ID NOs: 43-134, SEQ ID NOs:210-242, SEQ ID NOs:261-644, or a nucleotide sequence encoding one or more polypeptides having the amino acid sequence of any one of SEQ ID NOs:29-42, SEQ ID NOs:135-209, SEQ ID NOs:243-260, SEQ ID NOs:665-1046) can be introduced into a cell by any method known to those of skill in the art.

In some embodiments of the invention, transformation of a cell comprises nuclear transformation. In other embodiments, transformation of a cell comprises plastid transformation (e.g., chloroplast transformation).

Procedures for transforming plants are well known and routine in the art and are described throughout the literature. Non-limiting examples of methods for transformation of plants include transformation via bacterial-mediated nucleic acid delivery (e.g., via *Agrobacteria*), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol. Lett.* 7:849-858 (2002)).

*Agrobacterium*-mediated transformation is a commonly used method for transforming plants, in particular, dicot plants, because of its high efficiency of transformation and because of its broad utility with many different species. *Agrobacterium*-mediated transformation typically involves transfer of the binary vector carrying the foreign DNA of interest to an appropriate *Agrobacterium* strain that may depend on the complement of vir genes carried by the host *Agrobacterium* strain either on a co-resident Ti plasmid or chromosomally (Uknes et al. (1993) *Plant Cell* 5:159-169). The transfer of the recombinant binary vector to *Agrobacterium* can be accomplished by a triparental mating procedure using *Escherichia coli* carrying the recombinant binary vector, a helper *E. coli* strain that carries a plasmid that is able to mobilize the recombinant binary vector to the target *Agrobacterium* strain. Alternatively, the recombinant binary vector can be transferred to *Agrobacterium* by nucleic acid transformation (Höfgen & Willmitzer (1988) *Nucleic Acids Res.* 16:9877).

Transformation of a plant by recombinant *Agrobacterium* usually involves co-cultivation of the *Agrobacterium* with explants from the plant and follows methods well known in the art. Transformed tissue is regenerated on selection medium carrying an antibiotic or herbicide resistance marker between the binary plasmid T-DNA borders.

Another method for transforming plants, plant parts and/or plant cells involves propelling inert or biologically active particles at plant tissues and cells. See, e.g., U.S. Pat. Nos. 4,945,050; 5,036,006 and 5,100,792. Generally, this method involves propelling inert or biologically active particles at the plant cells under conditions effective to penetrate the outer surface of the cell and afford incorporation within the interior thereof. When inert particles are utilized, the vector can be introduced into the cell by coating the particles with the vector containing the nucleic acid of interest. Alternatively, a cell or cells can be surrounded by the vector so that the vector is carried into the cell by the wake of the particle. Biologically active particles (e.g., dried yeast cells, dried bacterium or a bacteriophage, each containing one or more nucleic acids sought to be introduced) also can be propelled into plant tissue.

Thus, in particular embodiments of the invention, a plant cell can be transformed by any method known in the art and as described herein and intact plants can be regenerated from these transformed cells using any of a variety of known techniques. Plant regeneration from plant cells, plant tissue culture and/or cultured protoplasts is described, for example, in Evans et al. (*Handbook of Plant Cell Cultures, Vol. 1*, MacMilan Publishing Co. New York (1983)); and Vasil I. R. (ed.) (*Cell Culture and Somatic Cell Genetics of Plants*, Acad. Press, Orlando, Vol. I (1984), and Vol. II (1986)). Methods of selecting for transformed transgenic plants, plant cells and/or plant tissue culture are routine in the art and can be employed in the methods of the invention provided herein.

Likewise, the genetic properties engineered into the transgenic seeds and plants, plant parts, and/or plant cells of the invention described above can be passed on by sexual reproduction or vegetative growth and therefore can be maintained and propagated in progeny plants. Generally, maintenance and propagation make use of known agricultural methods developed to fit specific purposes such as harvesting, sowing or tilling.

A nucleotide sequence therefore can be introduced into the plant, plant part and/or plant cell in any number of ways that are well known in the art. The methods of the invention do not depend on a particular method for introducing one or more nucleotide sequences into a plant, only that they gain access to the interior of at least one cell of the plant. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, in separate transformation events, or, for example, in plants, as part of a breeding protocol.

Thus, in additional embodiments, the invention provides a method of producing a plant having increased resistance to infestation by a nematode plant pest, the method comprising the steps of (a) crossing a transgenic plant of the invention with itself or another plant to produce seed comprising a recombinant nucleic acid molecule or vector of the invention; and (b) growing a progeny plant from said seed to produce a plant having increased resistance to infestation by nematode plant pests. In some embodiments, the method further comprises (c) crossing the progeny plant of (b) with itself or another plant and (d) repeating steps (b) and (c) for an additional 0-7 (e.g., 0, 1, 2, 3, 4, 5, 6, 7) generations to produce a plant having increased resistance to infestation by nematode plant pests.

In further embodiments, a method of producing a soybean plant having increased resistance to infestation by a nematode plant pest is provided, the method comprising the steps of (a) crossing a transgenic soybean plant of the invention with itself or another soybean plant to produce soybean seed comprising a recombinant nucleic acid molecule or vector of the invention; and (b) growing a progeny soybean plant from said seed to produce a soybean plant having increased resistance to infestation by nematode plant pests. In some embodiments, the method further comprises (c) crossing the progeny soybean plant of (b) with itself or another soybean plant and (d) repeating steps (b) and (c) for an additional 0-7 (e.g., 0, 1, 2, 3, 4, 5, 6, 7) generations to produce a soybean plant having increased resistance to infestation by nematode plant pests.

The invention further provides a plant crop comprising a plurality of transgenic plants of the invention planted together in an agricultural field.

In addition, a method of improving the yield of a plant crop when said plant crop is contacted with a nematode plant pest is provided, the method comprising cultivating a plurality of plants comprising a recombinant nucleic acid molecule of the invention as the plant crop, wherein the plurality of plants of said plant crop have increased resistance to nematode infection, thereby improving the yield of said plant crop as compared to a control plant crop contacted with said nematode plant pest, wherein the control plant crop is produced from a plurality of plants lacking said nucleic acid molecule. In some particular embodiments of the invention, the crop is a soybean crop.

In some embodiments, a method of improving the yield of a crop when said crop is contacted with a nematode plant pest is provided, the method comprising contacting the nematode plant pest with an effective amount of a polypeptide of the invention or a nematicidal composition of the invention, wherein the yield of the crop is improved as compared to a plant crop contacted with a nematode plant pest that has not been contacted with said polypeptide and/or nematicidal composition. In some particular embodiments of the invention, the crop is a soybean crop.

In still other embodiments, the invention further provides methods for controlling a nematode plant pest, methods of reducing the infectivity of a nematode plant pest toward a plant, methods of reducing infestation of a plant by a nematode plant pest, methods of reducing nematode cyst development, and methods of reducing the growth of a nematode plant pest comprising contacting the nematode plant pest with a composition of the invention, wherein said composition comprises a recombinant nucleic acid molecule, a nucleotide sequence, and/or a polypeptide of this invention. In some particular embodiments, the composition of the invention is a transgenic plant cell, transgenic plant or transgenic plant part comprising and expressing a recombinant nucleic acid molecule/nucleotide sequence of the invention.

Accordingly, in one embodiment, the invention provides a method of controlling a nematode plant pest, comprising contacting the nematode plant pest with an effective amount of a polypeptide of the invention or composition thereof, thereby controlling the nematode plant pest as compared to the control of a nematode plant pest which has not been contacted with said polypeptide or composition thereof.

Thus, in a further embodiment, the invention provides a method of controlling a nematode plant pest, comprising contacting the nematode plant pest with a transgenic plant and/or a part thereof comprising a recombinant nucleic acid molecule of the invention, thereby controlling the nematode plant pest as compared to the control of a nematode plant pest contacted with a control plant or plant part, said control plant lacking said recombinant nucleic acid molecule.

To "contact" a nematode plant pest with a polypeptide of the invention and/or composition thereof or to "deliver" to a nematode plant pest a polypeptide of the invention and/or composition thereof means that the nematode plant pest comes into contact with, is exposed to, the polypeptides of this invention and/or compositions thereof, resulting in a toxic effect on and control of the nematode (e.g., control, reduced infectivity, reduced infestation, reduced cyst formation, reduced growth, and the like). A nematode plant pest can be contacted with a polypeptide of the invention or nematicidal composition of the invention using any art known method. For example, contacting includes but is not limited to, (1) providing the polypeptide(s) of the invention in a transgenic plant, wherein the nematode eats (ingests) one or more parts of the transgenic plant, (2) in a protein composition(s) that can be applied to the surface of a plant or plant part, for example, sprayed onto the plant surface, applied as a soil drench near the plant roots, or as a dip for a whole plant or parts thereof (e.g., roots) or (3) any other art-recognized delivery system.

"Effective amount" refers to that concentration or amount of a polypeptide or nematicidal composition that inhibits or reduces the ability of a nematode plant pest to survive, grow, feed and/or reproduce, or that limits nematode-related damage or loss in crop plants. Thus, in some embodiments of the invention, an "effective amount" can mean killing the nematode. In other embodiments, an "effective amount" does not mean killing the nematode.

The term "control" in the context of an effect on an organism (e.g., nematode plant pest) means to inhibit or reduce, through a toxic effect, the ability of the organism to survive, grow, feed, and/or reproduce, or to limit damage or loss in crop plants that is related to the activity of the organism. To "control" an organism may or may not mean killing the organism, although in some embodiments "control" means killing the organism.

Thus, in particular embodiments, the overexpression of a nucleic acid molecule of the invention in a plant results in the production of the encoded polypeptide, thereby conferring on a plant resistance to a nematode plant pest. While not wishing to be bound by any particular theory, the polypeptides of this invention may have a "direct toxic" effect on the nematodes or instead may be triggers for the production of other proteins or metabolites or for one or more different pathways any of which may exert a toxic effect on nematode plant pests.

In other embodiments of the invention, a method of reducing the infectivity of a nematode plant pest to a plant is provided, the method comprising contacting the nematode plant pest with an effective amount of a polypeptide of the invention, thereby reducing the infectivity of the nematode plant pest to the plant as compared to the infectivity of a nematode plant pest to which said polypeptide has not been delivered.

As used herein, "infect," and "infectivity" means the ability of the nematode plant pest to infect, infest or parasitize a plant host. "Infest" and "infestation" refers to a pest nematode inhabiting or overrunning a plant in numbers or quantities that are large enough to be harmful to the plant.

In some embodiments of the invention, a method of reducing the infectivity of a nematode plant pest to a plant is provided, the method comprising contacting the nematode plant pest with a transgenic plant comprising a recombinant nucleic acid molecule of the invention, thereby reducing the infectivity of the nematode plant pest as compared to a nematode plant pest contacted with a control plant or plant part, wherein said control plant lacks said recombinant nucleic acid molecule.

In other embodiments, the invention provides a method of reducing nematode cyst development by a nematode plant pest on the roots of a plant, comprising contacting a nematode plant pest with an effective amount of the polypeptide of the invention, wherein nematode cyst development by the nematode plant pest on the roots of said plant is reduced as compared to cyst development on the roots of a plant by a nematode plant pest not contacted with said polypeptide.

In additional embodiments, a method of reducing nematode cyst development by a nematode plant pest on roots of a plant is provided, the method comprising contacting a nematode plant pest with the roots of a transgenic plant comprising a recombinant nucleic acid molecule of the invention, wherein cyst development by the nematode plant pest on the roots of the transgenic plant is reduced as compared cyst development on the roots of a control plant lacking said recombinant nucleic acid molecule.

In other embodiments of the invention, a method of reducing the growth of a nematode plant pest population is provided, the method comprising contacting the nematode plant pest population with an effective amount of a polypeptide of the invention, wherein the growth of a nematode plant pest population is reduced as compared to the growth of a control nematode plant pest population not contacted with the polypeptide.

In still other embodiments, a method of reducing the growth of a nematode plant pest population is provided, the method comprising contacting the nematode plant pest population with a transgenic plant comprising a recombinant nucleic acid molecule of the invention, wherein the growth of a nematode plant pest population is reduced as compared to the growth of a nematode plant pest population contacted with a control plant or plant part, said control plant or plant part lacking the recombinant nucleic acid molecule.

Thus, when a transgenic plant comprising a recombinant nucleic acid molecule of the invention, or a part thereof, is exposed to or brought into contact with a nematode plant pest such that the nematode feeds on or otherwise contacts the transgenic plant or part thereof, the ability of the nematode plant pest to survive, grow, feed, and/or reproduce in association with a plant is inhibited or reduced, thereby controlling the nematode/nematode population and/or reducing the ability of the nematode plant pest to infect or infest a plant or produce cysts on a plant. Additionally, one or more polypeptides of the invention or compositions comprising one or more polypeptides of the invention can be used directly to control or reduce the growth of a nematode plant pest, thereby reducing the ability of the nematode plant pest to infect or infest a plant or produce cysts on a plant.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1

Construction of Expression Cassettes for Hairy Root Transformation

At least one nucleic acid of the invention comprising a nucleotide sequence of any one of the nucleotide sequences of SEQ ID NOs:1-28, SEQ ID NOs:43-134, SEQ ID NOs: 210-242, SEQ ID NOs:261-644, or a nucleotide sequence encoding any one of the polypeptides having the amino acid sequences of SEQ ID NOs:29-42, SEQ ID NOs:135-209, SEQ ID NOs:243-260, SEQ ID NOs:665-1046, is cloned into an expression cassette having the basic structure from 5' to 3' of: 5'-promoter-nucleic acid of the invention-terminator-3'. Expression cassettes may also comprise enhancers, introns, leader sequences and the like. One such expression cassette has the structure: prActin2 (including Act2 intron): cEVO18010081 (SEQ ID NO:24):tNOS or prActin2 (including Act2 intron):cEVO18010044 (SEQ ID NO:224): tNOS. Other nucleic acids of the invention can be substituted for the cEVO18010081 or EVO18010044 coding sequence to create different expression cassettes. The expression cassette is then cloned into a binary expression vector to create a hairy root (HR) transformation vector. A cEVO18010081 (SEQ ID NO:24) or cEVO18010044 (SEQ ID NO: 224) HR transformation vector was created by cloning the cEVO18010081 (SEQ ID NO:24) or cEVO18010044 (SEQ ID NO: 224) expression cassette, respectively, and a second expression cassette encoding a scorable marker into a binary vector. As an example, the resulting HR transformation vector 20844 comprising cEVO18010081 (SEQ ID NO:24) is shown in FIG. 1.

Example 2

Expression in Transgenic Soybean Roots

Figure 2:
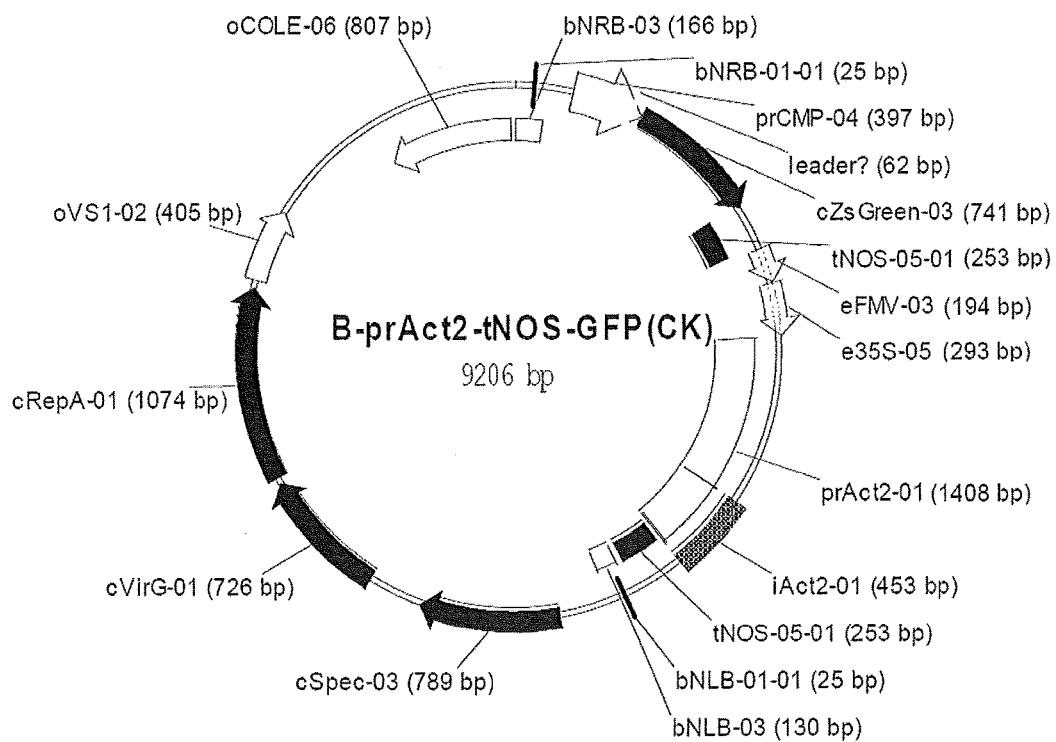
FIG. 2 is an empty vector useful as a negative control in plant and/or plant cell transformation experiments.

The binary expression vector described in Example 1 containing a nucleic acid of the invention and an empty vector (without a nucleic acid of the invention) shown in FIG. 2 was transformed into soybean roots to test the binary vector's ability to express a protein that is capable of reducing soybean cyst nematode (SCN) cysts. Soybean cultivar Williams 82 was used as the germplasm for the hairy root transformation. Soybean seeds were germinated on 1% agar containing 0.5% sucrose in Petri dishes at approximately 27° C. for 5 days. The cotyledons were then cut off the seedlings, and the wounded surface was inoculated with cultures of an *Agrobacterium rhizogenes* strain (e.g., K599) carrying the binary expression vector or empty vector. The cotyledons were placed on 1% agar for about 6 days and then transferred onto selection media. In about two weeks, independent transgenic hairy root events induced from the cotyledons were harvested and transferred onto culture media, and cultured in the darkness at about 27° C. Narayanan et al. (*Crop Science* 39, 1680-1686 (1999)) indicates that SCN resistance phenotypes in a whole soybean plant are preserved in transgenic hairy roots, therefore the transgenic hairy root system is useful for evaluating candidate SCN resistance genes and predicting activity in whole soybean plants.

Approximately two weeks after transfer onto the culture plates, the transformed hairy roots were inoculated with surface-sterilized J2 stage soybean cyst nematodes (SCN J2) and the roots were grown in darkness at about 27° C., which allows cyst formation on the hairy root events. One month after nematode inoculation, the number of cysts were determined for the roots expressing the polynucleotides of SEQ ID NOs:15-28, 31, 35, 225, 227, 228, 230-234, or 238-240 (i.e., producing the polypeptides of SEQ ID NOs: 29-38, 40-42, 52, 243, 244, 246, 248-252, 25, or 256-259) or for roots expressing the polynucleotides of SEQ ID NOs:1047-1062 and for roots expressing the empty vector (as a negative control). The experiments were repeated at least one time.

The results of the experiments are shown in Tables 1-25 below.

TABLE 1

| Plasmid_ID | Nucleotide sequence | Average cyst number (Avg) | Number of hairy root events (n) | Standard error (SE) |
|---|---|---|---|---|
| SCNBHR10 | SEQ ID NO: 15 | 22.1 | 17 | 2.5 |
| SCNBHR25 | SEQ ID NO: 21 | 24 | 3 | 5.6 |
| SCNBHR52 | SEQ ID NO: 23 | 12.2 | 11 | 3.4 |
| SCNBHR81 | SEQ ID NO: 24 | 33.6 | 14 | 4 |
| SCNBHRCK | Empty Vector | 21.2 | 11 | 3 |

TABLE 2

| Plasmid_ID | Nucleotide sequence | Avg | n | SE |
|---|---|---|---|---|
| SCNBHR18 | SEQ ID NO: 18 | 10.8 | 16 | 2.4 |
| SCNBHR21 | SEQ ID NO: 20 | 6.4 | 18 | 1.2 |
| SCNBHR25 | SEQ ID NO: 21 | 10.5 | 13 | 1.1 |
| SCNBHR36 | SEQ ID NO: 22 | 12 | 8 | 1.7 |
| SCNBHR52 | SEQ ID NO: 23 | 2 | 1 | |
| SCNBHR84 | SEQ ID NO: 27 | 14.1 | 20 | 1.4 |
| SCNBHRCK | Empty Vector | 13.3 | 9 | 1.7 |

TABLE 3

| Plasmid_ID | Nucleotide sequence | Avg | n | SE |
|---|---|---|---|---|
| SCNBHR15 | SEQ ID NO: 17 | 15 | 9 | 3.6 |
| SCNBHR82 | SEQ ID NO: 25 | 16.9 | 15 | 2.5 |
| SCNBHRCK | Empty Vector | 10.4 | 12 | 1.6 |

TABLE 4

| Plasmid_ID | Nucleotide sequence | Avg | n | SE |
|---|---|---|---|---|
| SCNBHR10 | SEQ ID NO: 15 | 15 | 2 | 2 |
| SCNBHR15 | SEQ ID NO: 17 | 12.3 | 7 | 2.4 |
| SCNBHR36 | SEQ ID NO: 22 | 14.5 | 10 | 2.6 |
| SCNBHR52 | SEQ ID NO: 23 | 6 | 1 | |
| SCNBHR81 | SEQ ID NO: 24 | 5 | 3 | 0 |
| SCNBHR82 | SEQ ID NO: 25 | 8 | 1 | |
| SCNBHRCK | Empty Vector | 20.5 | 2 | 2.5 |

TABLE 5

| Plasmid_ID | Nucleotide sequence | Avg | n | SE |
|---|---|---|---|---|
| SCNBHR11 | SEQ ID NO: 16 | 27.6 | 16 | 2.3 |
| SCNBHR19 | SEQ ID NO: 19 | 24.1 | 16 | 3 |
| SCNBHR83 | SEQ ID NO: 26 | 17.8 | 14 | 2.2 |
| SCNBHR88 | SEQ ID NO: 28 | 21.6 | 13 | 2.7 |
| SCNBHRCK | Empty Vector | 18.5 | 10 | 2.5 |

TABLE 6

| Plasmid_ID | Nucleotide sequence | Avg | n | SE |
|---|---|---|---|---|
| SCNBHR10 | SEQ ID NO: 15 | 43 | 1 | |
| SCNBHR15 | SEQ ID NO: 17 | 41.3 | 3 | 12.4 |
| SCNBHR21 | SEQ ID NO: 20 | 27.9 | 7 | 2.9 |
| SCNBHR36 | SEQ ID NO: 22 | 32 | 3 | 11.9 |
| SCNBHR52 | SEQ ID NO: 23 | 42.7 | 7 | 4.2 |
| SCNBHR81 | SEQ ID NO: 24 | 19 | 1 | |
| SCNBHR83 | SEQ ID NO: 26 | 31.5 | 2 | 1.5 |
| SCNBHRCK | Empty Vector | 60.8 | 5 | 4 |

TABLE 7

| Plasmid_ID | Nucleotide sequence | Avg | n | SE |
|---|---|---|---|---|
| SCNBHR40 | SEQ ID NO: 1047 | 34.5 | 12 | 6 |
| SCNBHR44 | SEQ ID NO: 225 | 29.6 | 12 | 3.5 |
| SCNBHR47 | SEQ ID NO: 227 | 29.1 | 13 | 3.5 |
| SCNBHR50 | SEQ ID NO: 1048 | 31.1 | 13 | 3.2 |
| SCNBHR55 | SEQ ID NO: 1049 | 36.5 | 15 | 3.8 |
| SCNBHR57 | SEQ ID NO: 1050 | 40.1 | 14 | 3.2 |
| SCNBHR60 | SEQ ID NO: 232 | 20.7 | 11 | 3.2 |
| SCNBHR65 | SEQ ID NO: 1051 | 33.8 | 11 | 5.9 |
| SCNBHRCK | Empty Vector | 39.9 | 11 | 4.3 |

TABLE 8

| Plasmid_ID | Nucleotide sequence | Avg | n | SE |
|---|---|---|---|---|
| SCNBHR43 | SEQ ID NO: 1052 | 70.9 | 7 | 4.8 |
| SCNBHR48 | SEQ ID NO: 228 | 23.3 | 7 | 9.7 |
| SCNBHR52 | SEQ ID NO: 23 | 24.8 | 4 | 6.2 |
| SCNBHR71 | SEQ ID NO: 1053 | 66.6 | 8 | 11.1 |
| SCNBHR72 | SEQ ID NO: 1054 | 71.6 | 9 | 5.2 |
| SCNBHR79 | SEQ ID NO: 1055 | 108.8 | 4 | 32.6 |
| SCNBHR91 | SEQ ID NO: 1056 | 48 | 4 | 12.2 |
| SCNBHRCK | Empty Vector | 72.7 | 3 | 22.3 |

TABLE 9

| Plasmid_ID | Nucleotide sequence | Avg | n | SE |
|---|---|---|---|---|
| SCNBHR58 | SEQ ID NO: 1057 | 43.6 | 8 | 6 |
| SCNBHR59 | SEQ ID NO: 231 | 97 | 13 | 8.1 |
| SCNBHR86 | SEQ ID NO: 1058 | 58.4 | 7 | 15.2 |

TABLE 9-continued

| Plasmid_ID | Nucleotide sequence | Avg | n | SE |
|---|---|---|---|---|
| SCNBHR89 | SEQ ID NO: 1059 | 45.5 | 6 | 7 |
| SCNBHRCK | Empty Vector | 62.9 | 10 | 9.4 |

TABLE 10

| Plasmid_ID | Nucleotide sequence | Avg | n | SE |
|---|---|---|---|---|
| SCNBHR43 | SEQ ID NO: 1052 | 44.9 | 10 | 5.1 |
| SCNBHR79 | SEQ ID NO: 1055 | 44.7 | 12 | 4.2 |
| SCNBHR91 | SEQ ID NO: 1056 | 30.7 | 3 | 9.8 |
| SCNBHRCK | Empty Vector | 46.8 | 10 | 5.8 |

TABLE 11

| Plasmid_ID | Nucleotide sequence | Avg | n | SE |
|---|---|---|---|---|
| SCNBHR71 | SEQ ID NO: 1053 | 65 | 7 | 11 |
| SCNBHR72 | SEQ ID NO: 1054 | 53.7 | 8 | 8.9 |
| SCNBHR91 | SEQ ID NO: 1056 | 46 | 3 | 7.6 |
| SCNBHRCK | Empty Vector | 65.4 | 8 | 7.4 |

TABLE 12

| Plasmid_ID | Nucleotide sequence | Avg | n | SE |
|---|---|---|---|---|
| SCNBHR48 | SEQ ID NO: 228 | 34.6 | 8 | 7.4 |
| SCNBHR61 | SEQ ID NO: 233 | 53.2 | 6 | 5.9 |
| SCNBHR73 | SEQ ID NO: 238 | 44 | 7 | 8 |
| SCNBHR77 | SEQ ID NO: 239 | 34.8 | 6 | 6.4 |
| SCNBHRCK | Empty Vector | 78 | 9 | 10.6 |

TABLE 13

| Plasmid_ID | Nucleotide sequence | Avg | n | SE |
|---|---|---|---|---|
| SCNBHR68 | SEQ ID NO: 1060 | 46.2 | 6 | 10.7 |
| SCNBHR70 | SEQ ID NO: 1061 | 53.7 | 3 | 12.8 |
| SCNBHR80 | SEQ ID NO: 240 | 34.5 | 2 | 7.5 |
| SCNBHR85 | SEQ ID NO: 1062 | 45 | 2 | 5 |
| SCNBHRCK | Empty Vector | 55.2 | 6 | 6.3 |

TABLE 14

| Plasmid_ID | Nucleotide sequence | Avg | n | SE |
|---|---|---|---|---|
| SCNBHR15 | SEQ ID NO: 17 | 45.8 | 12 | 3.6 |
| SCNBHR21 | SEQ ID NO: 20 | 51.1 | 14 | 4.1 |
| SCNBHR36 | SEQ ID NO: 22 | 50.4 | 5 | 4.9 |
| SCNBHR52 | SEQ ID NO: 23 | 45.5 | 13 | 4.1 |
| SCNBHR66 | SEQ ID NO: 236 | 62 | 7 | 11.7 |
| SCNBHR77 | SEQ ID NO: 239 | 57.2 | 12 | 6 |
| SCNBHR81 | SEQ ID NO: 24 | 30.2 | 12 | 2.6 |
| SCNBHRCK | Empty Vector | 65.7 | 17 | 5.8 |

TABLE 15

| Plasmid_ID | Nucleotide sequence | Avg | n | SE |
|---|---|---|---|---|
| SCNBHR10 | SEQ ID NO: 15 | 63 | 11 | 3.9 |
| SCNBHRCK | Empty Vector | 97.4 | 14 | 8.3 |

TABLE 16

| Plasmid_ID | Nucleotide sequence | Avg | n | SE |
|---|---|---|---|---|
| SCNBHR59 | SEQ ID NO: 231 | 398.1 | 19 | 17.15435 |
| SCNBHRCK | Empty Vector | 312.4 | 11 | 29.17074 |

TABLE 17

| Plasmid_ID | Nucleotide sequence | Avg | n | SE |
|---|---|---|---|---|
| SCNBHR43 | SEQ ID NO: 1052 | 84.5 | 14 | 6.8 |
| SCNBHR58 | SEQ ID NO: 1057 | 85.4 | 9 | 5.9 |
| SCNBHRCK | Empty Vector | 89.8 | 11 | 4.2 |

TABLE 18

| Plasmid_ID | Nucleotide sequence | Avg | n | SE |
|---|---|---|---|---|
| SCNBHR54 | SEQ ID NO: 230 | 69.9 | 13 | 4.9 |
| SCNBHR61 | SEQ ID NO: 233 | 66.3 | 13 | 5.1 |
| SCNBHR73 | SEQ ID NO: 238 | 96.5 | 13 | 11.6 |
| SCNBHRCK | Empty Vector | 103.2 | 13 | 9.6 |

TABLE 19

| Plasmid_ID | Nucleotide sequence | Avg | n | SE |
|---|---|---|---|---|
| SCNBHR60 | SEQ ID NO: 232 | 82.6 | 9 | 5.8 |
| SCNBHRCK | Empty Vector | 145.8 | 10 | 17.8 |

TABLE 20

| Plasmid_ID | Nucleotide sequence | Avg | n | SE |
|---|---|---|---|---|
| SCNBHR80 | SEQ ID NO: 240 | 65.3 | 19 | 4.6 |
| SCNBHRCK | Empty Vector | 61 | 14 | 5.4 |

TABLE 21

| Plasmid_ID | Nucleotide sequence | Avg | n | SE |
|---|---|---|---|---|
| SCNBHR47 | SEQ ID NO: 227 | 57.5 | 13 | 3.7 |
| SCNBHR53 | SEQ ID NO: 229 | 61.9 | 16 | 3.4 |
| SCNBHR92 | SEQ ID NO: 242 | 85.3 | 15 | 5.6 |
| SCNBHRCK | Empty Vector | 81.5 | 16 | 5 |

TABLE 22

| Plasmid_ID | Nucleotide sequence | Avg | n | SE |
|---|---|---|---|---|
| SCNBHR83 | SEQ ID NO: 26 | 75.7 | 15 | 5.9 |
| SCNBHRCK | Empty Vector | 104.7 | 14 | 8. |

TABLE 23

| Plasmid_ID | Nucleotide sequence | Avg | n | SE |
|---|---|---|---|---|
| SCNBHR44 | SEQ ID NO: 225 | 97.9 | 20 | 5 |
| SCNBHR60 | SEQ ID NO: 232 | 72.3 | 12 | 5.8 |
| SCNBHR63 | SEQ ID NO: 234 | 102.5 | 19 | 5.7 |
| SCNBHR82 | SEQ ID NO: 25 | 109.8 | 17 | 3.9 |
| SCNBHRCK | Empty Vector | 109.6 | 16 | 4.8 |

TABLE 24

| Plasmid_ID | Nucleotide sequence | Cysts | n | SE |
|---|---|---|---|---|
| SCNBHR77 | SEQ ID NO: 239 | 63 | 18 | 3.3 |
| SCNBHRCK | Empty Vector | 71 | 13 | 4.4 |

TABLE 25

| Vector | Nucleotide sequence | Cysts | n | SE |
|---|---|---|---|---|
| SCNBHR54 | SEQ ID NO: 230 | 36 | 19 | 2.3 |
| SCNBHR73 | SEQ ID NO: 238 | 40 | 11 | 1.5 |
| SCNBHRCK | Empty Vector | 33 | 19 | 2.3 |

The results of these experiments show that the number of cysts formed on soybean roots expressing at least a polynucleotide sequence having the nucleotide sequence of SEQ ID NO:15, SEQ ID NO:17, SEQ ID NO:20, SEQ ID NO:22, SEQ ID NO:23, SEQ ID NO:24, SEQ ID NO:26, SEQ ID NO:227, SEQ ID NO:228, SEQ ID NO:230, SEQ ID NO:232 and/or SEQ ID NO:233 was significantly lower than on transgenic soybean roots comprising the empty vector control. Those skilled in the art would understand that the genomic sequences and/or mRNA plus UTR and ORF sequences corresponding to the above SEQ ID NOs as provided herein could also be used to reduce nematode parasitism (e.g., SEQ ID NOs:1, 3, 6, 8, 9, 10, 12, 43, 45, 48, 50, 51, 53, 211, 212, 214, 216, 217).

Polynucleotides having substantial sequence identity (e.g., at least 80% identity) to the polynucleotides shown above as reducing the number of cysts on soybean roots may also be useful for reducing nematode infestation, cyst number, and the like, in plants. Non-limiting examples of polynucleotides having substantial identity to the nucleotide sequence of SEQ ID NO:15 include the nucleotide sequences of SEQ ID NOs: 56-60; to the nucleotide sequence of SEQ ID NO:17 includes the nucleotide sequence of SEQ ID NO:63; to the nucleotide sequence of SEQ ID NO:20 includes the nucleotide sequences of SEQ ID NO:66 and/or SEQ ID NO:67; to the nucleotide sequence of SEQ ID NO:22 includes the nucleotide sequences of SEQ ID NOs:68-112; to the nucleotide sequence of SEQ ID NO:23 includes the nucleotide sequences of SEQ ID NOs: 113-118; to the nucleotide sequence of SEQ ID NO:24 includes the nucleotide sequence of SEQ ID NO:119; to the nucleotide sequence of SEQ ID NO:26 includes the nucleotide sequences of SEQ ID NOs:120-124; to the nucleotide sequence of SEQ ID NO:227 includes the nucleotide sequences of SEQ ID NOs:226, 389-398; to the nucleotide sequence of SEQ ID NO:228 includes the nucleotide sequences of SEQ ID NOs:399-401; to the nucleotide sequence of SEQ ID NO:230 includes the nucleotide sequences of SEQ ID NOs:408-633; and/or to the nucleotide sequence of SEQ ID NO:232 includes the nucleotide sequences of SEQ ID NOs:637-642.

Example 3

Figure 3:
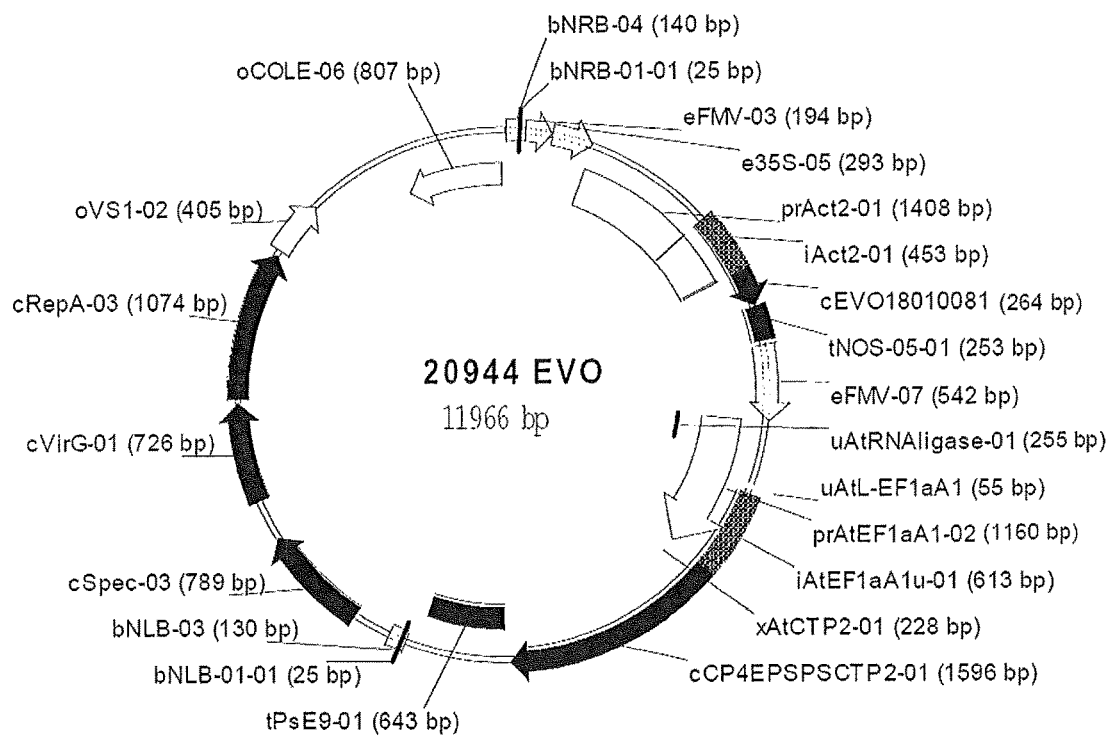
FIG. 3 is a binary vector useful for transforming plants and/or plant cells with a recombinant nucleic acid molecule of the invention.

Construction of Expression Cassettes and Vectors for Soybean Transformation The expression cassettes described in Example 1 are used in soybean transformation experiments or different expression cassettes are constructed. At least one nucleic acid comprising a nucleotide sequence selected from the nucleotide sequences of any one of SEQ ID NOs:1-28, 43-134, 210-242, 261-664 or nucleotide sequences encoding the polypeptide having the amino acid sequence of any one of SEQ ID NOs:29-42, 135-209, 243-260, 665-1046, is cloned into an expression cassette and the expression cassette cloned into a binary vector for the generation of transgenic soybean plants. The genetic material to be transferred to the soybean plant is cloned between the left border and the right border of the binary vector. One such expression cassette has the structure: eFMV:e35S:prAct2 (including Act2 intron): cEVO18010081 (SEQ ID NO:24):tNOS. The cEVO18010081 (SEQ ID NO:24) expression cassette and a second expression cassette encoding a selectable marker are cloned into a binary vector to create 20944 EVO shown in FIG. 3. Another exemplary expression cassette has the structure: eFMV:e35S:prAct2 (including Act2 intron): cEVO18010044 (SEQ ID NO:224):tNOS.

The binary vector comprising an expression cassette described above is introduced into an *Agrobacterium tumefaciens* strain (e.g., EHA101), using electroporation. Single bacterial colonies containing the binary vector are selected to confirm the presence of intact vector and used for further experiments.

Example 4

Production of Transgenic Soybean

Transformation of soybean to produce transgenic soybean plants was accomplished using targets prepared from germinated seeds of variety Williams 82 via *Agrobacterium tumefaciens*-mediated transformation as described here. Mature soybean seeds were harvested, dried and sterilized with chlorine gas. Sterilized seeds were placed in laminar flow hoods for 2 weeks before germination. Seeds were placed on germinated media for 15 to 40 hours for germination. Explants were prepared as described in Khan (US patent application 20040034889) using germinated seeds by removing hypocotyls, one cotyledon and primary leaf primordial. The explants were then wounded by gentle wounding at the cotyledonary nodal region and also apical regions. Explants were then infected with *Agrobacterium* strain EHA101 containing appropriate binary vector. Infected explants were co-cultured in co-cultivation media as described in Hwang et al 2008 (WO08112044). Excess *A. tumefaciens* suspension was then removed by aspiration and explants were moved to plates containing a non-selective co-culture medium. Explants were co-cultured with the remaining *A. tumefaciens* at 23° C. for 4 days in the dark. Explants were then transferred to recovery medium supplemented with an antibiotics mixture consisting of ticarcillin (75 mg/L), cefotaxime (75 mg/L) and vancomycin (75 mg/1) and incubated in the dark for seven days as described in Hwang et al 2008 (WO08112044). Explants were then transferred to regeneration medium containing glyphosate (75 to 100 uM) and a mixture of antibiotics consisting of ticarcillin (75 mg/L), cefotaxime (75 mg/L) and vancomycin (75 mg/1) to inhibit and kill *A. tumefaciens*. Shoot elongation was carried out in elongation media containing glyphosate (50 uM). The EPSPS gene was used as a selectable marker during the transformation process. Regenerated plantlets were transplanted to soil as described in Que et al (WO08112267) and tested for the presence of both EPSPS marker gene and spectinomycin resistance (Spec) sequences by TaqMan PCR analysis (Ingham et al., 2001). This screen allows for the selection of transgenic events that carry the T-DNA and are free of vector backbone DNA. Plants positive for EPSPS gene sequences and negative for the Spec gene were transferred to the greenhouse for analysis of miRNA expression seed setting. Using this method, genetic elements within the left and right border regions of the transformation plasmid are efficiently transferred and integrated into the genome of the plant cell, while genetic elements outside these border regions are generally not transferred.

When the roots are about 2-3 inches, they are transplanted into 1-gallon pots using Fafard #3 soil and 30 grams of incorporated Osmocote Plus 15-9-12. They are watered in thoroughly and placed in the cubicle under florescent lighting set to a 16-hour day. The temperatures are about 85° F. (29.4° C.) during the day and about 70° F. (21° C.) at night. Plants are watered at least once daily.

The plants remain in the cubicle until secondary Taqman sampling has been performed, typically 1-2 weeks. The plants are then placed on an automatic drip watering system and watered twice daily. A cage is placed over the plant, and it may be pruned very lightly if needed. The lighting is a combination of Metal Halide and Sodium Vapor fixtures with 400- and 1000-watt bulbs with a 10-hour day period. The outside wall is darkened to keep out light that would extend the day length. Temperatures are set at about 79° F. (26° C.) during the day and about 70° F. (21° C.) at night. The humidity is ambient.

The plants are maintained in this manner until pods reach maturity, approximately 100 days based on the date of the Taqman selection. The pods are then harvested, placed in a paper bag, air-dried for about 2-days, and then machine dried at about 80° F. (27° C.) for 2-additional days. The pods are shelled and the T1 seeds are harvested and stored at about 4° C. until further testing.

Figure 4:
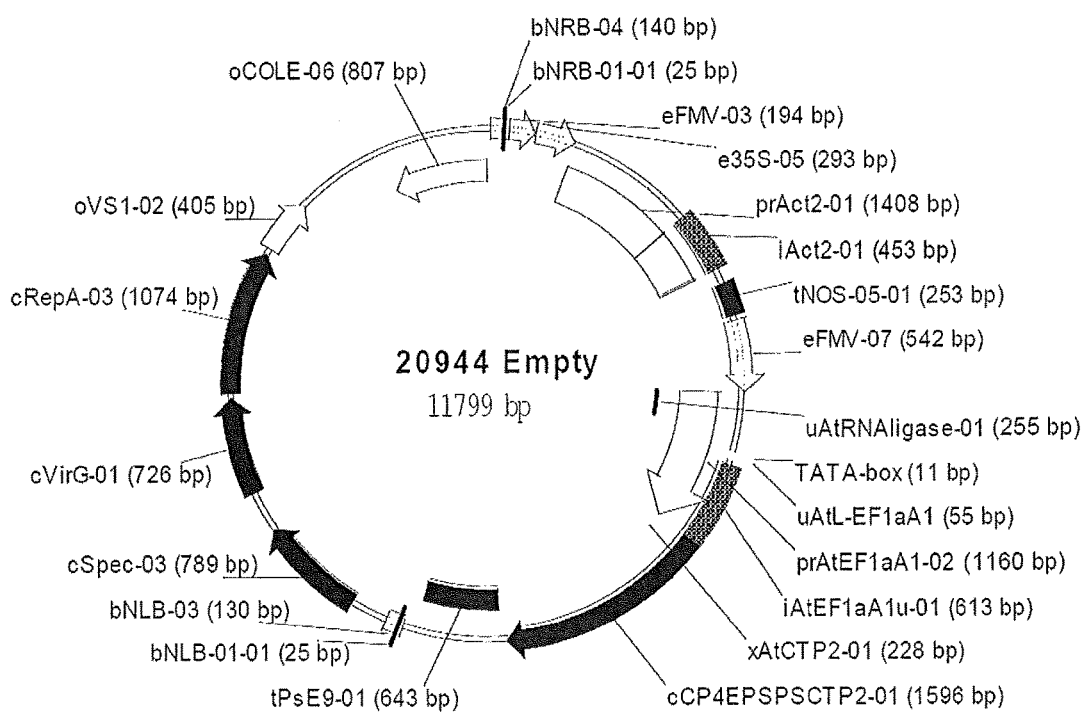
FIG. 4 is an empty vector useful as a negative control in plant and/or plant cell transformation experiments.

Wild type Williams 82 or null segregants of the T1 generation are used as a control in the SCN assay. Alternatively, a control in the SCN assay can be a plant transformed with an empty vector such as shown in FIG. 4 (i.e., an identical expression cassette but without a nucleotide sequence of SEQ ID NOs:1-28, SEQ ID NOs: 43-134, SEQ ID NOs:210-242, or SEQ ID NOs:261-644, and/or a nucleotide sequence encoding one or more polypeptides having the amino acid sequence of SEQ ID NOs: 29-42, SEQ ID NOs:135-209, SEQ ID NOs:243-260, or SEQ ID NOs:665-1046.

Example 5

Evaluation of Cyst Formation in the Transformed Soybean Plants

Soybean plants transformed with the expression cassette harboring at least one nucleotide sequence of any one of the nucleotide sequences of SEQ ID NOs:1-28, SEQ ID NOs: 43-134, SEQ ID NOs:210-242, SEQ ID NOs:261-644, or a nucleotide sequence encoding any one of the polypeptides having the amino acid sequence of any one of SEQ ID NOs: 29-42, SEQ ID NOs:135-209, SEQ ID NOs:243-260, or SEQ ID NOs:665-1046 are inoculated with J2 stage soybean cyst nematodes (SCN J2). 3-week old transgenic T1 generation soybean seedlings grown in germination pouches individually are inoculated with SCN J2 suspension at the level of 500 J2 per plant. The soybean plants were cultured at 27° C. in a growth chamber with 16 hours per day of light period.

One month after nematode inoculation, the number of cysts is determined for both the transgenic soybean plants comprising the at least one nucleotide sequence as set forth above and for the null segregants (plants not having a nucleic acid of the invention) from the same T0 parents.

Example 6

Evaluation of the Role of Selected Recombinant Nucleic Acids in Resistance and/or Tolerance to Nematodes To validate the role of selected polynucleotides of the invention in plant resistance and or tolerance to nematodes the selected polynucleotides were over-expressed in plants, as follows.

Cloning strategy Selected polynucleotides having a nucleotide sequence of SEQ ID NO:15, SEQ ID NO:16, SEQ ID NO:17, SEQ ID NO:18, SEQ ID NO:19, SEQ ID NO:20, SEQ ID NO:22, SEQ ID NO:23, SEQ ID NO:24, SEQ ID NO:26, SEQ ID NO:27, SEQ ID NO:228, or SEQ ID NO:1047 were cloned into binary vectors for the generation of transgenic plants.

For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from roots, leaves, flowers, siliques or other plant tissues, growing under normal and different treated conditions. Total RNA was extracted using methods well known in the art. Production of cDNA and PCR amplification was performed using standard protocols, which are well known to those skilled in the art (See, e.g., Sambrook J., E. F. Fritsch, and T. Maniatis. 1989. *Molecular cloning: a laboratory manual*, 2nd Ed. Cold Spring Harbor Laboratory Press, New York). PCR products were purified using PCR purification kit (Qiagen). In those instances where the entire coding sequence was not identified, RACE kit from Invitrogen (RACE=Rapid Amplification of cDNA Ends) was used to access the full cDNA transcript of the gene from the RNA samples described above. RACE products were cloned into high copy vector followed by sequencing or directly sequenced. The information from the RACE procedure was used for cloning of the full length ORF of the corresponding genes.

When genomic DNA was cloned, the genes were amplified by direct PCR on genomic DNA extracted from leaf tissue using the DNAeasy kit (Qiagen Cat. No. 69104). Typically, 2 sets of primers were synthesized for the amplification of each gene from a cDNA or a genomic sequence; an external set of primers and an internal set (nested PCR primers). When needed, an additional primer (or two) of the nested PCR primers was used.

To facilitate the cloning of the cDNAs/genomic sequences, an 8-12 bp extension was added to the 5' of each primer. The primer extension includes an endonuclease restriction site. The restriction sites were selected using two parameters: (a) the site does not exist in the cDNA sequence, and (b) the restriction sites in the forward and reverse primers are designed such that the digested cDNA is inserted in the sense formation into the binary vector that is utilized for transformation.

Each digested PCR product was inserted into a high copy vector pUC19 (New England BioLabs Inc) or into plasmids originating from this vector. In some cases, the undigested PCR product can be inserted into pCR-Blunt II-TOPO (Invitrogen).

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter (SEQ ID NO:1063) via digestion with appropriate restriction endonucleases. The insert is then followed by single copy of the NOS terminator (Vancanneyt et al. *Molecular Genetics and Genomics* 220, 245-50, 1990). The digested products and the linearized plasmid vector were ligated using T4 DNA ligase enzyme (Roche, Switzerland). High copy plasmids containing the cloned genes were digested with the restriction endonucleases (New England BioLabs Inc) according to the sites designed in the primers and cloned into binary vectors.

Several DNA sequences of the selected genes were synthesized by a commercial supplier GeneArt (www.geneart.com). Synthetic DNA was designed in silico. Suitable restriction enzymes sites were added to the cloned sequences at the 5' end and at the 3' end to enable later cloning into the pQFNc binary vector downstream of the At6669 promoter Binary vectors used for cloning: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, was replaced by the GUS-Intron gene followed by the NOS terminator. pGI was used in the past to clone the polynucleotide sequences, initially under the control of 35S promoter (Odell et al. *Nature* 313, 810-812 (28 Feb. 1985)).

Figure 5:
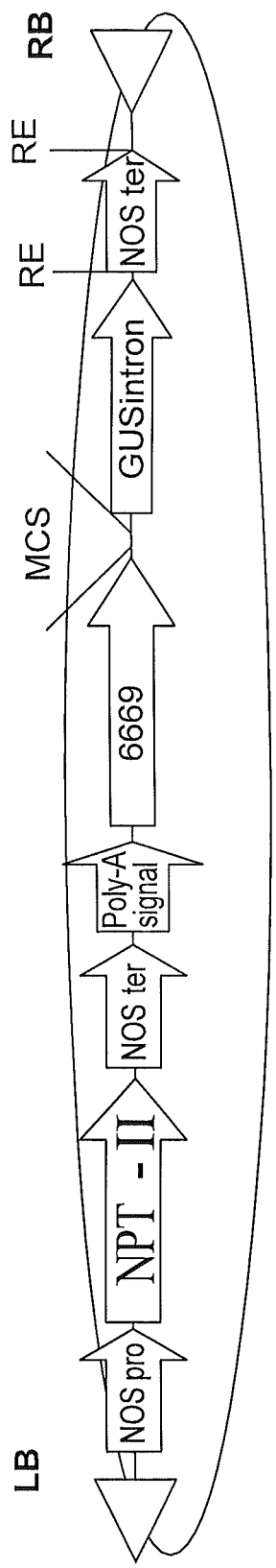
FIG. 5 is a schematic illustration of the modified pGI binary plasmid containing the At6669 promoter and the GUSintron (pQYN 6669) that can be used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). In some embodiments, the isolated polynucleotide sequences of the invention were cloned into the vector while replacing the GUSintron reporter gene.
Figure 6:
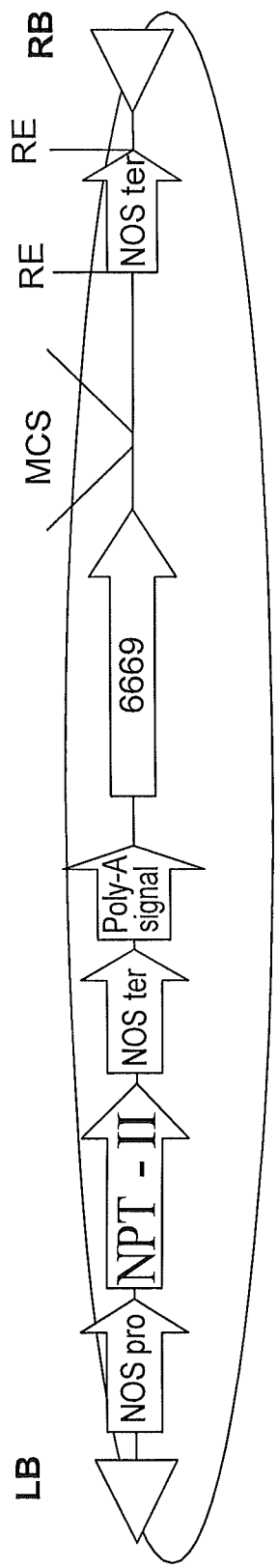
FIG. 6 is a schematic illustration of the modified pGI binary plasmid containing the At6669 promoter (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). In some embodiments, the isolated polynucleotide sequences of the invention were cloned into the MCS of the vector.
Figure 7:
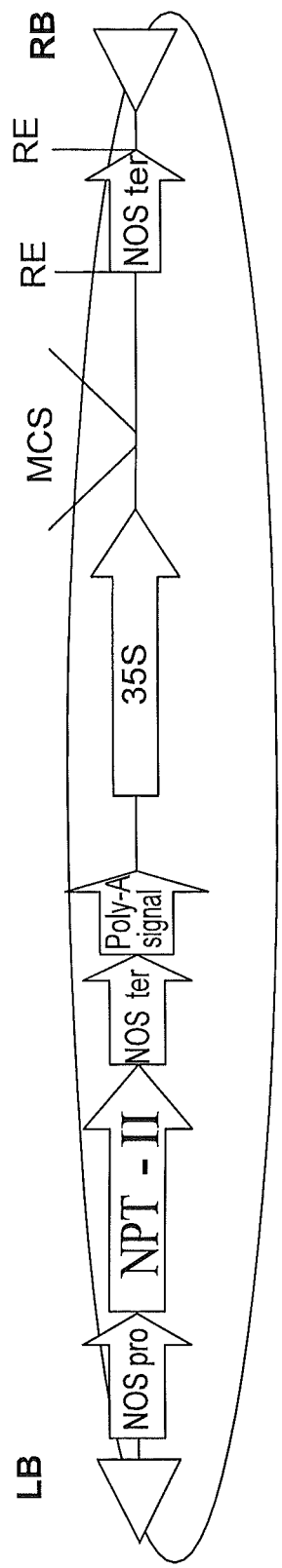
FIG. 7 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S- the 35S promoter. In some embodiments, the isolated polynucleotide sequences were cloned into the MCS (Multiple cloning site) of the vector.

The modified pGI vectors (pQXNc (FIG. 7); or pQFN (FIG. 6), pQFNc (FIG. 6) or pQYN 6669 (FIG. 5) are modified versions of the pGI vector in which the cassette was inverted between the left and right borders so the gene and its corresponding promoter are close to the right border and the NPTII gene is close to the left border.

At6669, the *Arabidopsis thaliana* promoter sequence (SEQ ID NO:1063) was inserted in the modified pGI binary vector, upstream to the cloned genes, followed by DNA ligation and binary plasmid extraction from positive *E. coli* colonies, as described above.

Colonies were analyzed by PCR using the primers covering the insert which were designed to span the introduced promoter and gene. Positive plasmids were identified, isolated and sequenced.

For cloning of each gene at least 2 primers were used, forward and reverse. In some cases, four primers were used: external forward, external reverse, nested forward or nested reverse. The genes were cloned from the indicated organism, except for the genes that were synthetically produced by GeneArt.

Example 7

Producing Transgenic *Arabidopsis* Plants Expressing Selected Polynucleotides

Production of *Agrobacterium tumefaciens* cells harboring the binary vectors according to some embodiments of the invention. Each of the binary vectors described in Example 6 above was used to transform *Agrobacterium* cells. An additional binary construct, having only the At6669 promoter was used as negative control. The binary vectors were introduced to *Agrobacterium tumefaciens* GV301, or LB4404 competent cells (about $10^9$ cells/mL) by electroporation. The electroporation was performed using a Micro-Pulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention were properly introduced to the *Agrobacterium* cells.

Preparation of *Arabidopsis* plants for transformation - *Arabidopsis thaliana* var Columbia ($T_0$ plants) were transformed according to the floral dip procedure (Clough et al. (1998) *Plant J.* 16(6): 735-43; and Desfeux et al. (2000) *Plant Physiol.* 123(3): 895-904) with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Preparation of the *Agrobacterium* carrying the binary vectors to transformation into *Arabidopsis* plants - Single colonies of *Agrobacterium* carrying the binary vectors harboring the genes of some embodiments of the invention were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contains half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of *Arabidopsis* plants with the *Agrobacterium* - Transformation of $T_0$ plants was performed by inverting each plant into an *Agrobacterium* suspension such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques are brown and dry, then seeds were harvested from plants and kept at room temperature until sowing.

Generation of T1 and T2 transgenic plants - For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital T$_1$ *Arabidopsis* plants were transferred to a fresh culture plates for another week of incubation. Following incubation the T$_1$ plants were removed from culture plates and planted in growth mix contained in 250 ml pots. The transgenic plants were allowed to grow in a greenhouse to maturity. Seeds harvested from T$_1$ plants were cultured and grown to maturity as T$_2$ plants under the same conditions as used for culturing and growing the T$_1$ plants.

Example 8

Evaluation of Transgenic *Arabidopsis* for Reduced Infection by Nematodes

The binary expression vector described above, pQFN or pQFNc including the At6669 promoter containing at least one nucleic acid of the invention or an empty vector (without a nucleic acid of the invention) were transformed into *Arabidopsis* to test the ability of the binary vector to express a protein that is capable of reducing sugar beet cyst nematode (BCN) cysts. *Arabidopsis* cultivar Columbia-0 was used as the germplasm for transformation. *Arabidopsis* seeds were germinated on 3% phytagel containing 0.5% sucrose in 1.5 ml tubes at approximately 25° C. for 10 days. Individual plants, 5 to 10 plants per event and 3 to 7 events per SEQ ID, were then transferred to 0.25 liter pots containing sand and grown for additional 10 days in the green house. The pots were then inoculated with J2 stage sugar beet cyst nematodes (BCN J2) and plants were grown in green house at about 25° C., which allows cyst formation on the root of the plants. One month after nematode inoculation, the number of cysts was determined for both the roots expressing at least one of the polynucleotides of SEQ ID NO:15, SEQ ID NO:16, SEQ ID NO:17, SEQ ID NO:18, SEQ ID NO:19, SEQ ID NO:20, SEQ ID NO:22, SEQ ID NO:23, SEQ ID NO:24, SEQ ID NO:26, SEQ ID NO:27, SEQ ID NO:228, or SEQ ID NO:1047 and the roots expressing the empty vector (as a negative control). The experiment was repeated at least one time.

TABLE 26

Genes showing reduced plant infection to nematodes.

| SEQ ID NO | Event # | Nematode female cysts per plant | | | % of control |
|---|---|---|---|---|---|
| | | Mean | SE (±) | p-Value | |
| Empty vector control | Mix135 | 9.89 | 1.20 | 1.00 | — |
| SEQ ID NO: 1047 | 61990.12 | 2.90 | 0.75 | <.0001 | 29 |
| SEQ ID NO: 1047 | 61991.13 | 7.10 | 1.67 | 0.34 | 72 |
| SEQ ID NO: 1047 | 61995.2 | 6.10 | 0.74 | 0.08 | 62 |
| SEQ ID NO: 228 | 60025.11 | 1.00 | 0.52 | <.0001 | 10 |
| SEQ ID NO: 228 | 62025.7 | 6.50 | 0.79 | 0.15 | 66 |
| SEQ ID NO: 228 | 62026.11 | 6.67 | 1.81 | 0.22 | 67 |
| SEQ ID NO: 16 | 62118.11 | 3.09 | 0.59 | <.0001 | 31 |
| SEQ ID NO: 16 | 62118.12 | 3.10 | 0.66 | 0.00 | 31 |
| SEQ ID NO: 16 | 62121.6 | 3.30 | 0.60 | 0.00 | 33 |
| SEQ ID NO: 16 | 62122.4 | 3.80 | 1.28 | 0.00 | 38 |
| SEQ ID NO: 16 | 62392.4 | 2.50 | 0.91 | <.0001 | 25 |

TABLE 27

Genes showing reduced plant infection to nematodes.

| SEQ ID NO | Event # | Nematode female cysts per plant | | | % of control |
|---|---|---|---|---|---|
| | | Mean | SE (±) | p-Value | |
| Empty vector control | mix138-b | 11.5 | 0.63 | 1 | — |
| SEQ ID NO: 18 | 61888.3 | 5.5556 | 1.11 | 0.012 | 48 |
| SEQ ID NO: 18 | 61888.4 | 2.8889 | 0.66 | <.0001 | 25 |
| SEQ ID NO: 18 | 61889.1 | 4.8889 | 1.18 | 0.0033 | 43 |
| SEQ ID NO: 18 | 61890.4 | 5.8889 | 1.55 | 0.0219 | 51 |
| SEQ ID NO: 18 | 61891.2 | 7.1111 | 1.46 | 0.1417 | 62 |
| SEQ ID NO: 24 | 61895.1 | 4 | 1.02 | 0.0013 | 35 |
| SEQ ID NO: 24 | 61896.1 | 4.75 | 0.68 | 0.0036 | 41 |
| SEQ ID NO: 24 | 61896.3 | 6.4 | 1.3182 | 0.0418 | 56 |
| SEQ ID NO: 24 | 61896.5 | 4.9 | 0.836 | 0.0024 | 43 |
| SEQ ID NO: 24 | 61896.6 | 3.5 | 0.85 | <.0001 | 30 |
| SEQ ID NO: 24 | 61897.1 | 5.2 | 1.96 | 0.033 | 45 |
| SEQ ID NO: 24 | 61897.3 | 3.8 | 1 | 0.0002 | 33 |
| SEQ ID NO: 24 | 61898.1 | 3.2857 | 0.81 | 0.0003 | 29 |
| SEQ ID NO: 17 | 62236.3 | 5.2 | 1.27 | 0.0045 | 45 |
| SEQ ID NO: 17 | 62237.2 | 2 | 0.67 | <.0001 | 17 |
| SEQ ID NO: 17 | 62237.3 | 3.1111 | 0.93 | <.0001 | 27 |
| SEQ ID NO: 17 | 62239.2 | 3.4 | 1.63 | 0.0018 | 30 |
| SEQ ID NO: 17 | 62240.4 | 6.1 | 1.83 | 0.0251 | 53 |

TABLE 28

Genes showing reduced plant infection to nematodes.

| SEQ ID NO | Event # | Nematode female cysts per plant | | | % of control |
|---|---|---|---|---|---|
| | | Mean | SE (±) | p-Value | |
| Empty vector control | Mix136 | 5.33 | 0.62 | 1 | — |
| SEQ ID NO: 15 | 61433.2 | 1.17 | 0.31 | 0.0241 | 22 |
| SEQ ID NO: 15 | 61454.2 | 1.83 | 0.75 | 0.1045 | 34 |
| SEQ ID NO: 15 | 61455.4 | 2.67 | 1.59 | 0.4177 | 50 |
| SEQ ID NO: 15 | 61457.2 | 2.5 | 0.85 | 0.3301 | 47 |
| SEQ ID NO: 19 | 61535.5 | 2.33 | 0.56 | 0.2553 | 44 |
| SEQ ID NO: 19 | 61536.5 | 2.17 | 0.6 | 0.1934 | 41 |
| SEQ ID NO: 19 | 61536.6 | 3.67 | 0.72 | 0.9621 | 69 |
| SEQ ID NO: 26 | 62570.3 | 1.33 | 0.49 | 0.0358 | 25 |
| SEQ ID NO: 26 | 62570.4 | 0.83 | 0.31 | 0.0104 | 16 |
| SEQ ID NO: 26 | 62570.5 | 0.75 | 0.75 | 0.0284 | 14 |
| SEQ ID NO: 26 | 62571.1 | 0.83 | 0.54 | 0.0104 | 16 |
| SEQ ID NO: 26 | 62573.5 | 0.17 | 0.17 | 0.0016 | 3 |
| SEQ ID NO: 26 | 62573.6 | 1.5 | 0.67 | 0.0522 | 28 |
| SEQ ID NO: 26 | 62873.3 | 0.67 | 0.33 | 0.0066 | 13 |
| SEQ ID NO: 26 | 62576.4 | 0.2 | 0.2 | 0.0035 | 4 |
| SEQ ID NO: 27 | 62578.1 | 0.83333 | 0.4 | 0.0104 | 16 |
| SEQ ID NO: 27 | 62578.3 | 0.8 | 0.8 | 0.0164 | 15 |
| SEQ ID NO: 27 | 62578.4 | 0.5 | 0.34 | 0.0042 | 9 |
| SEQ ID NO: 27 | 62579.1 | 1.16667 | 0.48 | 0.0241 | 22 |
| SEQ ID NO: 27 | 62579.2 | 0.66667 | 0.33 | 0.0066 | 13 |

TABLE 29

Genes showing reduced plant infection to nematodes.

| Gene name (SEQ ID NO) | Event # | Nematode female cysts per plant | | | % of control |
|---|---|---|---|---|---|
| | | Mean | SE (±) | p-Value | |
| Empty vector control | Mix135 | 8.75 | 2.25 | 1 | — |
| SEQ ID NO: 23 | 61448.2 | 2.86 | 1 | 0.0003 | 33 |
| SEQ ID NO: 23 | 61448.3 | 1.43 | 0.65 | <.0001 | 16 |
| SEQ ID NO: 23 | 61449.1 | 2.14 | 1.16 | <.0001 | 24 |
| SEQ ID NO: 23 | 61449.3 | 2.14 | 0.8 | <.0001 | 24 |

TABLE 29-continued

Genes showing reduced plant infection to nematodes.

| Gene name (SEQ ID NO) | Event # | Nematode female cysts per plant | | p-Value | % of control |
|---|---|---|---|---|---|
| | | Mean | SE (±) | | |
| SEQ ID NO: 23 | 61450.1 | 1.67 | 0.49 | <.0001 | 19 |
| SEQ ID NO: 23 | 61450.2 | 0 | 0 | <.0001 | 0 |
| SEQ ID NO: 23 | 61450.4 | 0.5 | 0.27 | <.0001 | 6 |
| SEQ ID NO: 23 | 61452.4 | 1.75 | 0.85 | 0.0001 | 20 |
| SEQ ID NO: 20 | 61724.1 | 0 | 0 | <.0001 | 0 |
| SEQ ID NO: 20 | 61724.4 | 0.71 | 0.57 | <.0001 | 8 |
| SEQ ID NO: 20 | 61725.2 | 3 | 1.2 | 0.0004 | 34 |
| SEQ ID NO: 20 | 61725.3 | 0 | 0 | <.0001 | 0 |
| SEQ ID NO: 20 | 61725.6 | 0 | 0 | <.0001 | 0 |
| SEQ ID NO: 20 | 61726.2 | 2.3 | 0.7 | <.0001 | 26 |
| SEQ ID NO: 20 | 61727.3 | 1.4 | 0.75 | <.0001 | 16 |
| SEQ ID NO: 22 | 62124.3 | 3.5 | 2.22 | 0.0081 | 40 |
| SEQ ID NO: 22 | 62125.1 | 0.43 | 0.2 | <.0001 | 5 |
| SEQ ID NO: 22 | 62125.3 | 0 | 0 | <.0001 | 0 |
| SEQ ID NO: 22 | 62126.1 | 1.57 | 0.69 | <.0001 | 18 |
| SEQ ID NO: 22 | 62126.3 | 4.33 | 1.67 | 0.0731 | 50 |
| SEQ ID NO: 22 | 62129.2 | 1 | 0.41 | <.0001 | 11 |

Results of these experiments (Tables 26-29) indicate that the number of cysts formed on *Arabidopsis* roots expressing, for example, at least one polynucleotide having the nucleotide sequence of SEQ ID NOs:16, 20, 22, 23, 24, 26, 27, 228 and/or 1047 was significantly lower than on transgenic soybean roots comprising the empty vector control.

Similar to the polynucleotides identified as reducing nematode cyst development on soybean hairy root, polynucleotides having substantial sequence identity (e.g., at least 80% identity) to the polynucleotides shown above as reducing the number of cysts on *Arabidopsis* roots may also be useful for reducing nematode infestation, cyst number and the like, in plants. Non-limiting examples of polynucleotides having substantial identity to the nucleotide sequence of SEQ ID NO:16 include SEQ ID NO:61 and/or SEQ ID NO:62; to the nucleotide sequence of SEQ ID NO:20 includes the nucleotide sequences of SEQ ID NO:66 and/or SEQ ID NO:67; to the nucleotide sequence of SEQ ID NO:22 includes the nucleotide sequences of SEQ ID NOs: 68-112; to the nucleotide sequence of SEQ ID NO:23 includes the nucleotide sequences of SEQ ID NOs:113-118; to the nucleotide sequence of SEQ ID NO:24 includes SEQ ID NO:119; to the nucleotide sequence of SEQ ID NO:26 includes the nucleotide sequences of SEQ ID NOs:120-124; to the nucleotide sequence of SEQ ID NO:27 includes the nucleotide sequences of SEQ ID NOs:125-127; and/or to the nucleotide sequence of SEQ ID NO:228 includes the nucleotide sequences of SEQ ID NOs:399-401.

Altogether, the results from Tables 1-29 show that the polynucleotides/polypeptides of the invention can be useful for increasing resistance and or tolerance to plant nematodes.

The foregoing is illustrative of the invention, and is not to be construed as limiting thereof. The invention is defined by the following claims, with equivalents of the claims to be included therein.

SEQUENCE LISTING (1063 sequences)

SEQ ID NO: 1 - DNA, 1244 bp, Arabidopsis thaliana
atcactcaccacaaagtcttctcatttcctcatcttcttgttgaaagtaatggcaagactcacgagctttctccttcttctttctctcatctgctttgtccctctctgtctctgcgacaagagctatggaggcaaacttttcccgggttattacgcccattcatgcccacaagtcaatgagatcgtgagatcagttgtagctaaagctgttgctagagagacacgtatggctgcttccttgttgagacttcatttccacgactgtttcgttcagggttgtgatggctctttgcttctagacagcagtggaagggtagcgactgagaaaaactcaaaccctaacagcaaatcagctcgtgggtttgacgtagttgaccaaatcaaagctgaactggagaaacaatgccctggaactgtttcttgcgctgatgttcttaccctagccgctagagactcctctgttcttaccggtggaccaagttgggttgttccattgggaagaagagattcaagaagtgcaagcttgagtcaatcgaacaacaacatccctgcaccaaacaacactttccagaccattctatctaagtttaaccgtcaaggacttgatatcactgaccttgtcgctctctccggtagtcacacaatcggattctcgagatgcacgagtttcagacagaggttgtacaaccagtccggaaacggcagtccagacatgacattggaacaatccttcgctgctaacttgcgccaacggtgtccaaaatccggtggggaccagattctctcggtgctagacatcatcagcgccgcgagcttcgacaacagctacttcaagaacttgatagagaacaaggggttgttgaactcggaccaagttctgttcagcagtaacgagaaatcgagagagcttgtgaagaagtatgcagaagatcaaggagagttttttgagcaatttgcggaatcgatgatcaagatgggaaatatctctcccttgacaggttctagtggcgaaatcaggaagaattgcaggaagattaactcttgattgaaacaagaaaactcttcttatatcttgtggaacaaatgtgagacatttacttttactttggagtgtgttttgtttgtttttttcaattctgtcatttggaagttttatttcgtgttatttgcgttgtgttaagacataagtttgaaatttataaaacttgtacgaggaaatattttgaaattataaactttaaact

SEQ ID NO: 2 - DNA, 2893 bp, Arabidopsis thaliana
atacatacacttctctttttatcctccatcggcggcttatggcggttttccggcactaatcatctccggcatatataaataaacgtacttcacgtttttttatataacttcaaagtagtttcagatttgtctctatctcttcacttttaagtcttctggttttgtcatcaccagctttttttgttctgtctctgtctttctctttgtgtatttttattctcgtcatcgttgttcttctatgagaggaagatcggaatgtcgaagagaattagaagattctcgtacatcacttcgttggaatttcacaggtcgatgagagatctgagaactgtttcattttgatccaaactcatctctttcagagtataatggactaagcattttttttctccgaagatggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatgatggcgtttactgttttcaagatgttgactgctttagtctcttgtgctactgcgattacgcttattactttgattcctctgcttttgaaagttaaagttagagagtttatgcttaagaagaaagctcatgagcttggtcgtgaagttggtttgattttgattaagaaagagactggctttcatgttcgtatgcttactcaagagattcgtaagtctttggatcgtcatacgattctttatactactttggttgagctttcgaagactttagggttgcagaattgtgcggtttggatgccgaatgacggtggaacggagatggatttgactcatgagttgagagggagaggtggttatggtggttgttctgtttctatggaggatttggatgttgttaggattagggagagtgatgaagtgaatgtgttgagtgttgactcgtccattgctcgagctagtggtggtggtggggatgttagtgagattggtgccgtggctgctattagaatgccgatgcttcgtgtttcggattttaatggagagctaagttatgcgatacttgtttgtgttttaccgggcgggacgcctcgggattggacttatcaggagattgagattgttaaagttgtggcggatcaagtaaccgttgcgttagatcatgcagcggttcttgaagagtctcagcttatgagggagaagctggcggaacagaacagggcgttgcagatggcgaagagagacgcgttgagagcgagccaagcgaggaatgcgtttcagaaaacgatgagcgaagggatgaggcgtcctatgcattcgatactcggtcttttgtcgatgattcaggacgagaagttgagtgacgagcagaaaatgattgttgatacgatggttaaaacagggaatgttatgtcgaatttggtgggggactctatggatgtgcctgacggtagatttggtacggagatgaaaccatttagtctgcatcgtacgatccatgaagcagcttgtatggcgagatgtttgtgtctatgcaatggaattaggttcttggttgacgcggagaagtctctacctgataatgtagtaggtgatgaaagaagggtctttcaagtgatacttcatatagttggtagtttagtaaagcctagaaaacgtcaagaaggatcttcattgatgtttaaggttttgaaagaaagaggaagcttggataggagtgatcatagatgggctgcttggagatcaccggcttcttcagcagatggagatgtgtatataagatttgaaatgaatgtagagaatgatgattcaagttctcaatcatttgcttctgtttcctccagagatcaagaagttggtgatgttagattctccggcggctatgggttaggacaagatctaagctttggtgtttgtaagaaagtggtgcagttgattcatgggaatatctcggtggtccctggctcggatggttcaccggagaccatgtcgttgctccttcggtttcgacgtagaccctccatatctgtccatggatccagcgagtcgccagctcctgaccaccacgctcacccacattcgaattctctgttacgtggcttacaagttttattggtagacaccaacgattcgaaccgggcagttacacgtaaactcttagagaaactcgggtgcgatgtaaccgcggtttcctctggattcgattgccttaccgccattgctcccggctcgtcctcgccttctacttcgtttcaagtggtggtgcttgatcttcaaatggcagagatggacggttatgaagtggccatgaggatcaggagtcgatcttggccgttgattgtggcgacgacagtgagcttggatgaagaaatgtgggacaagtgtgcacagattggaatcaatggagttgtgagaaagccagtggtgttaagagctatggagagtgagctccgaagagtattgttgcaagctgaccaacttctctaagttgttatctcaacttctcttctacattcaaaatttttacaccatagatttatgtcaaatatatcaaaatgaaatttcgaaattgttattatatataccacccatatctctatgatttgtacatcctgtttttttttgttctttttctcattttgaaccccacgaaattgcattg

SEQ ID NO: 3 - DNA, 1067 bp, Arabidopsis thaliana
ttaagaagtagcagaacaatggcgacttctcagcaatttttaaaccctacactcttcaaatccttagcttcctcaaacaaaaactcatgtactctctgcccatctcctttcttgcaactcaagtccgcctccacaattttcaattacaaaccacttacttcctcctccgccacgatcatcacacgcgtcgctgcatcatcctccgattcaggcgagtcaataaccagagagactttccacggcctctgcttcgtcttgaaagacaacatcgacaccgatcaaataatccccgccgagtacggcactctcatcccttcgattccagaagatcgcgagaaactcggctctttcgcgcttaacggcttaccaaaattctacaacgaacgtttcgttgttccaggagagatgaaatcaaagtactcagtcatcatcggcggcgataatttcggttgcggatcttcccgcgaacacgctccagtttgtctcggcgcggcgggagctaaagctgtggtggcggaatcgtacgctaggatctttttcaggaactgtgtagctacaggtgagattttcccgttggaatcggaggttaggatttgcgacgagtgcaaaacaggggatgtggtgacaatcgaacacaaggaagacggtagtagtttgctgatcaatcatacgacgaggaaagaatacaaactgaaaccgctcggtgatgccggtccggtgatcgacgccggtggaatcttcgcttatgcaagaaaagccggcatgattccttctgcttgaatgtaatcggatccataatttatcggttctgagtttaatccggtttggtttatttggttcgagaaccggtactaacgaaataaattattaccaaaccaaaatttcttctggttcgactttgtttgccacgtggaaacagcgatataaacaagtgcccaaaaaggcttgcaatggtttttgtacaagaccttcgttttcttcaatgttcctcttttcttagatgcatttgcatgtcctctcgaactgaaagtttaaggttcttcttctgccttcgcatctgtactaag

SEQ ID NO: 4 - DNA, 1854 bp, Arabidopsis thaliana
ttgagcagtgaaattaatggcaataaaagagcgatcactagaggaaacaccaacatgggctgttgctgtagtttgcttcgttctccttttcatttccatcatgatcgaatacttcttgcactttattggtcactggtttaagaagaagcacaagaaagctttatctgaagctcttgaaaaggttaaagcagaactgatgcttctgggattcatatcgcttctattggttgtattgcaaacaccagtctccgagatttgcattccaagaaatattgctgcgacttggcatccttgtagcaaccatcaagaaatcgccaaatatggtaaagattatatcgacgatggccgcaaaattcttgaagattttgactccaacgacttttacagtcctcgccgaaatttagccaccaagggttatgacaaatgcgcagaaaaggggaaagtagcattagtatctgcctatggtatccaccagctgcatatattcatctttgtgctcgctgtttttcatgttctctactgcattataacctatgctttaggaaagaccaagatgaagaaatggaagtcatgggagagagagaccaaaacaattgagtaccaatatgccaatgatccagagaggttcagatttgcaagagatacatcgttcggacgtagacatctgaatatatggagcaagtctacctttaccctctggattacatgtttcttcagacagttctttggatcagtgacaaaagtagattatcttacactaagacatggctttattatggcacatttgccagcaggaagtgccgctcgtttcgatttccaaaaatacattgaaagatctttggaacaagatttcacggtggttgtcggtataagcccactgatatggtgcattgctgtcttattcatattgaccaatacacatggatgggactcatatctttggctgcccttccttcccttgattgtgatattgatagtaggagcaaaacttcaaatgataatatcgaaattaggattaaggattcaagaaaaaggagatgtggttaaaggagctcctgtggttgaaccgggcgatgatctcttttggtttggtcgtcctcgtttcattctcttcctcattcacttggttcttttcacgaatgcatttcaactggctttcttcgtttggagcacttacgaattcacactcaaaaactgcttccaccacaaaacagaagacattgcaattaggatcaccatgggggtattaatacaagttctatgcagctacatcactctacctctctatgctcttgttactcagatgggaacatcaatgaggccgacaatattcaacgacagggtagccaatgcattgaagaaatggcaccacacagccaagaaacagacgaaacatggacactcaggatctaacacacctcactcgagccgtcctactacgccaacacatggcatgtcaccggtgcatctcctccacaactacaataaccgcagcctcgaccaacaaaccagcttcactgcttctccttctcctcctagattctctgattatagcggccaaggccatggccatcagcatttcttcgaccctgaatctcagaatcactcttaccaacgtgagatcacagattctgaattcagcaatagtcatcatccccaagttgacatggcaagtcctgttagagaagagaaggagattgttgagcatgtcaaggttgatttgtctgagtttacgttcaagaagtgataggactatactttttacattctgtttgttcattctttgtaaatgatatgaacttaggaatgaacacttttcttatttctttatctgaattttgctataagctcaaa

SEQ ID NO: 5 - DNA, 1704 bp, Arabidopsis
gatctcttcctttgattcttcttctaatcttcttcaatggcgattccaaggtttagctctctgttacggtgtagaaaatgggctaaaagtgactggcttgtcgcttctataggatgcgtattgatcgtttttttcctctctttcttcttcgatcccacttcagactctgtcccctccgttgaccgatctcggccaatcatatctcctagcgatctggtcaagctgaagttgtcgagtgtagctaaagagagaggagctttttgtttggatggaagcttgcctgggtaccactttcatgagggttctggatctggctcccaaagctggcttgttcatttggagggtggaggctggtgcaacacagttgcgtcatgttctgctcgagcattgactaaattaggttcttccaactactttgaacaagaagtggcctttcaaggtgttttaagtagtgacccatctcaaaatcctgaattctttaactggaacaaggttgcgataaggtactgtgatggtgcttctttttctggacgccctgaagctgaattcaagaatggcacacggcttttcttccggggccagcttatttgggaggctattattgatgaacttttgtcaatgggcatgtcagatgccaaacaggccatacttacaggatgttctgccggtggcttggcaagtcttatacattgtgactactttcgagatcatcttccaaaagatgcagctgtcaaatgtgtttctgatggaggctactttctcaacgtgcctgatgtccttggaaacccaacaatgaggtctttctatcatgatgttgttaatttgcagggcgtagagaagagcttggatcagaaatgtgtagccaaaacggagccatctaagtgtatgtttcctcaagaattcctgaaaaacataagaactccggtatttcttgtcaatccagcctacgatttttggcagattcaacatgtcttggtaccaacttctgcggatccagataaaagttgggcaaagtgcagactcaatattaaggaatgtgatgccgaacagattaaagttctacacggttttcgcagttctatgatgactgcaattggggaatttcatcagaacaaagatggtgggatgttcatagattcctgctatgctcattgccagacagtcatgtccgtgacatggcactccctgacctcaccaagaatcgaaaataagacaattgcagagtctgtaggtgactggtacttcaacagaaaaccggtgaagctaatcgattgtccatacccgtgcaatccttcttgttacaacatgaatttcacatgaacttgccttatatcctcattttaccacttcctctgcttgtggactttttcgattctccagaagcttcttcagcaagggagcagtcacttcctcaaaattctcaatccgggaccagtctgtataatttttgacgtaatccggtggtaagacccagatgtcggttgtatgtgtacctgcttatttcacctgcaaatatcagagaaaacacattcaagtttagtgttaggattttcgaaaacccccagtaattaatgttttatcccaaaatgtcaccttttccagctcctccttcactaactgctcctttttcgctgttacccgattgtcaagggcaagatacgctacatagaattttaaatcgacgaaaacttaagcatcatcatt

SEQ ID NO: 6 - DNA, 1810 bp, Arabidopsis thaliana
tcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaagatggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctagattcgtttcgcagagaaatcgaaggtcttagctcttatgagccagttattacccctctgtgctcagaaatctccaatggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttattaagttttttttggtaagttatttattttattaagttttgtagtatatcgtcgttattcgttaagataataatcaatttgttttc

SEQ ID NO: 7 - DNA, 1705 bp, Medicago
aagcaaatagacaatcattcaaacttcactcctttttggtttcaacctaattctttctgcttgctgcaaatatgtctggaagaaaaccctatgctgttgctcagtatggctgtcttcttgtaactcatgcggtaaagaagacggtagaggaagttgatggaaataaatgtgtatctgattggtttggcaaaggctatatgaaagttgaaagacaaaagaagaaactcatttcaaatcgtgatcgtgtgcgtgcacaagttgaagcaattgacagtaaaactgaaaaggttagagatgttgtgtttgagtggctaaaagaagcagaaatagtcatgcaaaaaatggagaatcttaaattacaatcaaaaccaccatcatggattgaatttaataaattgcaggaaaaaattacagcactaaataagaaatgtaattttgagccattttcaactacaattccaagtttagaacacttctctttaggaaataatttcgagtgtttcaagtcgacggagaaggcttcagatgaacttttggaggcactgcaagatgataattgttgtatgataggattgtacggtaggcgtgactctggtaaaactacgttggtgaaagtaatggaacagaaagtccaatatttgaatatttttgatgagattttatttgtcaatgtgaccaaaaacccaaatatcacagcaatgcaagatgaaattgctgactccttgaatataagatttgatagaaacagtgaagctggaagagcaagaagaatattatccacaatagaagatatggatcgtccaatacttgttatctttgatgatgttcgggcaaaatttgacctacgggatgtaggaattccttctaatagtaatcgatgcaaggtacttttgaccgcacgtcgccaaaaatattgtgacttagtttactgtcaaaggaagattctacttgatcccttatctacagaggaagcttcgacgttgtttgaaaaatattcaggcattctcgaagaggatcactcctcctcatttgacttattgaatgtggcacgtgaaattgcttttgaatgtgatgggttaccaggaaaaatcattaaggcagggtcttccgtaagaagtaaaccaatggaggaatgggaaaaatcactagacaatttgagacattcaactgctcaatgggagatgtttctcagttttagaggggaagatactcgctactcttttacaggtagtctttttcaagctttatcccaagggggattcaagactttcatggatgatgaaggactgcacactggggaccgagtttcaccttgtcttagaaatgcaattgaagcatcaagactttcgattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaatggttatggcaaagacatggctcaacatgaaaaaaaattcggaattgactcggagagagtacaaaaatggaagtcagcattgcttgaagtttctaatttgtccggaatgacttacacgactgggtatgaatatgaatttatccaaaagattgtagaagatgccaataatattaaaagtcgtttgcaaatacgaagcgtatagactataga

SEQ ID NO: 8 - DNA, 2088 bp, Medicago
tctgtaccacactcctttgtccattcctggccatgtgcgtgtgcggtgcccatttgatatcatattcatccaccttccacttcccttccctttgtttatttatagtattattaaaaaggtgtctttattaagttatctagcttcttcacttcgagttcattcattcattcagtgaaatggcaccgaacttggtgttattatgtgttagtgtttacctctttgccatcactacaactattattgttgctgaagatccatacaggttcttcaactggaacgttacctatggtgacatttatccacttggtgttcgccaacagggaatacttatcaatggccaattcccaggaccagacattcattctgtgacaaatgataatctcattatcaatgtcttcaacagcttggatgaaccttttctcatttcatggaatggagtccagcagagaaggaactcatacgaagatggagtgtttggaacaacatgtcccattccacctggaaagaacttcacatacatacttcaagtaaaagatcaaattggtagtttctattatttcccatctcttgcattccacaaagctgctggtggttttggaggaattagaattctaagtaggccaagaattcccgttcccttcgatgatcccgctggtgattacactgtcctcattggagattggtacaagtccaaccacacggatttgaaggcccaacttgataacggaaagaagttgcctttccctgatggaattcttatcaatggtcgtgggtctggaggatcatctctcaatgtggagcaaggaaagacttacaggcttagaatatcaaacgtgggattggaaaattcactcaactttcgcatacagaaccacaagatgaagctggtagaagtggaaggaacacacaccctccaaaccacctattcctcccttgacgttcacgtcggtcaatcatactcagttctagtaaccgcagatcaacctagtcaagactattatattgttgtttcctctcgatttaccaatcctgtactcacctccactggaattcttcgctacagcaactctgcaggcccagtttcaggtccaccccccggtggacccaccatccaaatcgactggtccttgaaccaagcccgttctattaggacaaacctgacggcaagtggaccaagaccaaatccgcaaggatcataccattacggcatgataaacttaacgaggacaattgtactatcaagttcagctggacaagttaatgggaaacaaagatacgcaattaacagcgtgtcttatgttgcccccgacactcctcttaagctggctgatttcttcaagatagcaggtgtttaccgtcctggaagcatctctgatagacctagtggtggtggtatttacctcgacacttctgttatgcaaactgactacagaacatttgttgagattgttttccaaaatgacgaagacatccttcagagctatcatctagatggctactctttctttgttgttggtatggatggaggacaatggacaagtgataaaaggaaccagtacaatcttcgagatgcagtttcgcgttccaccactcaggtatatccaaagtcatggactgctatctatgttccacttgacaatgtgggaatgtggaacttgaggtcagaattttgggcacgacaatatcttgggcaacagttttatatgcgtgtatacacaacatcaacatcactcagagatgaataccctattcctaagaatgcattactttgtggtagggcaactggaagacatactcgacccctttgatgacttacttagctaccacatgaatcaatattacttacttaattagcctttattagaagaatatgatcaaaaaagcagctaccttgtctgcttcttcttttattgttcgattgctttcattaattattgatgttgaactataaatgacccctactcgaggtcacattctttctcataagcaaacagaaacaatatattatattccaaaaaaaaaaaggaccgcctcggcctctagatctgagacacgcaacaggggtaggcaaggcacacaggggatagg

SEQ ID NO: 9 - DNA, 911 bp, Arabidopsis
cgaaaacaaaccacataaactagtcaaagaagaatagatgagttacattataaaaaagttcaagtgagagaaagagaggtccaatggcggagaaagaagaggatgtgaagcttctaggtttttgggcaagcccttttactcgtagagttgagatggctttcaagctcaaaggcgtgccttacgagtacttggagcaagatatagtgaacaagagccctttgcttctccagataaatccggtttacaagaaggttccggttcttgtctacaaagggaaaatattatccgagtcacatgtgatcctcgaatacatcgaccaaatatggaagaacaatccaattcttcctcaagatccttacgagaaagccatggctttattctgggccaagttcgttgatgaacaggttggaccagtagcttttatgtctgtggcaaaagcagagaagggagtagaggttgcaatcaaggaggctcaagaactctttatgtttcttgagaaggaagtcactggaaaagatttcttcggtggcaaaacaattggatttttggacttggtcgcaggaagtatgatcccgttttgtcttgctcgaggttgggaaggtatgggaattgatatgattccagaggaaaagtttccagagctaaacagatggatcaaaaatttgaaagaaattgagatcgtgagagaatgtattcctcctagagaggaacaaattgagcatatgaagaaagttgtagaaagaatcaaatcagcctaagagacaacaatgatactcttcgatcagtagatgttaactatatgtttgtgtaatcttgttataatagtttgtatgaacaataaatgaaacatttgtatgaacaattagtgtttttactaaattctaatgtcaattaattattataaacatttt

SEQ ID NO: 10 - DNA, 544 bp, Arabidopsis
aaacccgtcaacacatcttctttaagcatctctctcccttcaaagaaaatatcacaaaaatggcaaacgtctccgctttgctcaccatagctcttctcctttgctccacgctaatgtgcactgcccgccccgaaccggccatctccatctctatcacgactgctgccgatccatgtaacatggagaagaagatagaaggaaaattagatgacatgcatatggtagacgaaaactgtggtgcagacgacgaagattgcttaatgaggaggactttggtcgctcatactgattacatctatacccagaagaagaagcatccttgattttcacttactcatttctaacaaacttttgctcaagattatgtaatttatgtcatccttaattagtatttgtcacatacaagatcaagatagttatgattgtgattatttatatgtattttggatgatatattgtagaactagaagtttgacaataaaaagtttatagtgtcgttgtatgtttaagaagtttgacaataaaaactttatagtgttgttgc

SEQ ID NO: 11 - DNA, 3890 bp, Medicago
ctagaatctaccattcgaccttccacttaatttcttttccaacaaagccaacattttctttaaaagcttgtattcactgccaataaacttgtataacacacagcttttgctacaagacatagaataactcagcacaatacgagctacaaagttgtagcaattgttgaacaaatggaagcctcttcttcttcttcttgcagatcaagttcaaccacaagtttatgcacctaccatgtctttttgagttttcgaggagaagatacacgcaaaggattcaccgatcatttatgtgctgcccttgaaagaaaagggatcacaacttttaaagatgacaaagaccttgagagagggcaagtcatttcagaaaagctaatcaatgcaataaaagattctatgtttgccatcactattctctcaccagactatgcttcttccacttggtgtttggatgagcttcaaatgatcatggagtgcagcagcaaaaacaacctgcatgttttgccagtcttctatggtgtggatccatctgatgtaaggcatcaaagaggatgctttgaggaagctttcagaaaacatcaagagaaattcggtcaacacagtgacagggttgatagatggagagatgctttcacacaagttgccagttactctggatgggactccaagggccagcatgaggcgtcactagtcgaaaacattgctcaacacatacatagaaagttggttcctaaattgccatcttgtacagagaaccttgttgggattgtttcaaaggtggaggaagtaaacaagttcttaggtatggggttgaatgacgttcgctttataggcatatggggtatgggtggcataggcaagtcaactattgctagagcggtctatgaaacaatccgatgtgaatttgaacttacttgctttctagaaaatgttagagagatatctgagacaaatggtttagttcacttacaaagacaacttctttctcatctgagtataagtaggaatgattttcatgatttgtatgatgggaaaaaaacaatacaaaactctttatgcagaaaaaaggttctacttgttcttgatgatgtgaatgaactaaaccagttggagaatttggttgggaaacaagattggtttggtccgggaagtagagtaataatcacaacaagagacaagcacttgctaatgacacatggagtacataaaacctataaaactggaatgttatgcaaacatgatgcccttgttctcttttgtttgaaagcctttaaaggagataaaccacaagaagggtatttggacttatccaaagaagtggtggactattgtggtggtcttccattggcacttgaggtgttaggttcctatctgtatggaagaaatattgatgtttggcatagtgctgttaaaaaattaagaagttttccccaccctagagtccaagataacctgaaaataagttatgatagtttagataccatggagaaggatatttttctagatattgcttgtttctttaagggaatgaagggagataaagttatagatatattagaaagttgtggctatttccctcaaattggaattcaaattttgattgaaagatcattgataactctagattctgtgaataataaattgggaatgcatgatttgcttcaagaaatgggcagggatattgtatttcaggaatctccaaatgatccttgtagacgtagcaggttgtggtctcaagaggacattgatcgcgtcttgacaaaaaacaagggaactgaagcaattaacagtattgatatgaaattacttcaaccatatgaagcacattggaacactgaagcattctcaaagacaagtcagctaaaatttctcagtttatgtgagatgcaacttcctcttggcctcagttgccttcctagttcattaaaagttcttcactggagagggtgtcctttaaaaactctccctataacaactcaacttgatgaacttgttgacattacattatctcatagcaaaattgaacaactctggcaaggagtaaagtttatggaaaagatgaagtacttgaatttggctttttccaagaacctaaagagattgcctgatttttctggtgttccaaatcttgaaaaattgattcttgaaggctgtgaaggcctaattgaggttcatccatcccttgcacaccacaagaaagttgttctggtgaatttgaaagactgcaaaagtcttaaatctctttcagggaagttggagatgagttccctgaagaagttaattctttcaggcagcagtaaatttaaattccttccagagtttggggaaaaaatggaaaatttatcaatgcttgctttagaaggaacagatataagaaaactgcccttatcacttggaagactagtcggacttactaatttgaacttaaaggactgcaaaagcctggtttgtcttccagataccattcatggattgaattccctcataactctggacatttcaggatgctcaaaactttgtagactgccagatggtttaaaggaaatcaagtgtttggaggaactccatgccaatgatactgctattgatgaactaccttcctccattttttatctagatagtcttaaagttttatcatttgctggttgccaagggccatcgacaacgtcaatgaactggtttcttcccttcaatttgatgtttgggagtcaaccagcttccaatggattcagattaccaagttctgtcatgggattaccttctttggaatatttaaacctaagttattgtaatctttctgaagaatcattcccgaattattttcaccacctatcatctttgaagtctttggatctgactggtaacaattttgttatcataccaagtagcatttctaaactttcaaggcttagatttctttgtctaaattggtgccaaaagcttcaattgttgccagagcttccattaaccatgacacagttgaatgcaagcaattgtgattcactggacactatgaaatttaatccagcaaagctatgcagtctctttgcatcacctagaaaactgtcctacgttcaagaactttacaagagatttgaggatcgttgtctccccacaacaagatttgacatgcttatcccaggggatgaaattccatcttggtttgttcctcaaagatccgtttcctgggcaaaagtacatatccctaataatttccctcaagatgaatgggtaggatttgcattgtgtttcctattagtgagttatgctgacccacctgaattgtgtaagcatgagattgattgttatttgtttgcatctaatggtaagaagttaatcaccaccaggagtttacctcctatggacccatgttatcctcatctttatattctctacatgtccatcgatgaatttcgcgatgaaattctcaaagatgattactggagtgagagtggcattgaatttgtattgaaatgttactgctgtcaatcattgcaagtagtgagttgtggttcccgtttggtttgtaagcaagatgttgaagattggagcaaaatgagtcatttcaacgagagttgaagatatttgcagatcatatagttggtacttgtcaataacatcattccttgagatgcaagtaacatgatattacaaattggaccatcaagatgctgcacatgcatcttgaaacagtatcagatgcagaagaaatcttaaatattagaaagtttgaaacctgttttagtggtctttgtttaaagaagatggtaaagagtccaagataatcagcaacttgatgtggtttaaatttgaacttgatttatatgataacgattaattagttctgactgactcatgtaatatttcatctatatttaggtaaaattgaaacg

SEQ ID NO: 12 - DNA, 1272 bp, Arabidopsis
gtaaattctcagtctctcgtctgataatagttttgtagagtttggttaataaaactaatcgtgtacgctactaatacgtacaggtaattatttaatattcaaaaagatggctcaaaaagtggaagcagggggtggcgccggaggagcttcatgggatgatggtatccacgatggcgttagaaaggtgcatgtagggcaaggccaagatggtgtgtcatctatcaaagtcgtgtatgcgaaggactctcaggatattgaaggaagtgaacatggaaagaaaacgttacttggatttgaaacgtttgaggttgatgcagacgactacatagtagcagtgcaagtgacctacgacaacgtgtttggccaagactctgacatcatcacatctattaccttcaatacattcaagggaaaaacatctccaccctatggattggaaacgcaaaagaagtttgtactcaaggacaaaaacggtggtaaacttgttggcttccatggacgcgctggtgaagctttatatgctcttggagcatattttgctacaaccacaactcctgtgactcctgccaaaaaactatctgcaattggtggtgatgaaggaactgcatgggacgacggtgcgtacgatggtgtcaagaaggtgtacgtaggacaaggccaagatgggatatcagccgttaagtttgagtacaacaaaggcgcggagaatatcgtaggaggtgaacatggaaagcctactttactcggattcgaggagtttgagattgactatccaagtgaatacatcaccgcagttgaaggcacctatgataaaatctttgggagtgatggcctaatcataactatgcttaggttcaagactaataaacaaacgtctgctccctttggacttgaagctggcacagccttcgaacttaaagaggaagggcacaagatcgttggcttccatggaaaagccagtgagttgcttcatcagtttggagtccatgtcatgccactcaccaactgatcacattacagctacctccttcgcttccatcgaacttgttaatgtgatctcttgaaaataacttgttatacctatgatggttatgcctatctatgtttaaatgtttttaagcgttctcttttgtgatgttggtctttatataatgttacgtatgatagatttgaataaaggtggttgattccatccctataaattgcacattaagtcccatcgtgaacaacgttcgatccatactaaattaagttactgcaagtgtgtttagc

SEQ ID NO: 13 - DNA, 2165 bp, Arabidopsis
aaaatgggtcccacttttcccatttcccaacctccataaccaaagttggagatttctctgtttcctatgctctctctctctcttactctcacagtgactattcgtcgcttcagatctaaaagagaggaagataaaccatttggattcaatatcgattaaggaaaccttttgacttcacaagaatggcagtgacagaagcagaaaatcctcttcttggtgaaatcacttgtggcaccttactacagaagttgcaggaaatctgggatgaggttggggagagtgatgaagaacgagacaaactgcttctacagattgaggaagagtgtctgaatgtttacaaaaagaaagttgagctagccgcaaaatctcgtgcagagcttcttcagactttgtcagatgccactgttgaactttccaatctcacaactgctctcggggaaaaaagctatatcgacattcctgataagacttcaggaacgatcaaagaacaactttctgcaatagcacctgcgcttgaacaactttggcaacagaaagaggaaagggtccgggcattttctgatgtacaatcacagattcagaagatatgtgaggagatcgctggcggattgaacaatggacctcatgtggttgatgagactgacttgtctctaaagagattagatgacttccagaggaaactccaagagctccagaaagagaagagtgataggttacagaaggtgctcgagtttgtgagcacggtgcatgatctatgtgccgtccttcgtttagatttcttaagcactgtcaccgaagttcatccgagcttagatgaggcaaatggtgttcaaaccaagagcattagcaatgaaacacttgcaaggttggctaagactgtcttgactcttaaagaagataaaatgcaaagacttaagaagcttcaagaactagctactcagctaactgatctatggaatctgatggatacttctgatgaggaaagggagctttttgaccatgttacctctaacatttcagcttcagttcatgaagtgactgcctctggtgctctcgcacttgatcttatcgaacaggctgaggtggaagtggataggcttgatcaactgaaatctagcagaatgaaggaaattgcattcaaaaagcaatcagagcttgaggagatatatgctcgtgctcacatagaaataaaaccagaggttgttcgtgagaggatcatgtcgttgattgatgctgggaatactgaacctactgagttactggctgacatggatagccagatcgcaaaggccaaggaggaagcctttagtagaaaagaaattttagaccgtgtagagaaatggatgtcagcttgtgaggaagagagctggctcgaagattacaatcgagatcagaacaggtatagtgcaagccgaggtgcgcatttgaatctcaagagagctgagaaagctcggattctggtcagcaagattactgctatggttgacacgttgattgctaaaacccgggcatgggaagaggagaacagtatgtcctttgagtacgatggagttcctttactcgccatgctagatgaatacactatgcttaggcaagaacgagaagatgagaagcggaggctgaaagaacagaagaagcagcaagaacagccacacacagatcaagaatccgcctttgggtctaaaccaagccctgcaagacccgttagtgccaagaaaccggtgggaacacgagtcaatggaggagggctcaacgaaactcctatgaggcgtttgtctatgaactcaaaccagaacggaagcaagtccaagagagacagtctgaacaagatagcttcaccttcgaacattgtagccaacacaaaagatgatgctgcatctccagtctctcgtgctgacccagtgatggcttcaccgtgacaatatcaaaagaaagagagttataatgcttacttacacttttgttagttgctaatagtgctgtttaagaaacaaacacttagaaacaaagacaatgagagtagaatgttacttagatgtttctgtttctgtattcattcactcaaatttgtttggtacttgttagcatgactaatgtgaagtgaccggtttagtgaatgaaagtcaaggttctaattggaattacgaaataatatttgggcaaaa

SEQ ID NO: 14 - DNA, 1616 bp, Arabidopsis
ttgatatcatcactcgaataattcactttataactatctccgtcactatcaaaaagtgttcaaaattaaaaaagaatatctcaatccttatccacttcatcattcctagcttccaagttattattatataactcaatttttctggcttaagagttttgaaaaatatcttcactagagatgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcagattactgttcgacgcttgaaggtgatgactcttacagttgctggagagcttactttgaactcaaagatctcgaaagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactgaaagcggattacggattacggtacctttagaaagttgttatcttatcacagttatatgtaaatatagttcttggttttgctttagttcatgtagtctatcttttgttaagatgtgatcatattgccatagaaatgtggttgttattacttgatgttcgccaatgttgaatttgtttaatgctgtgtgcctattatagtactacgcggttttggtttacgaagagatttctattcttgataactgaagtggattactacggtacgacctatagaaagttgttttcttatcacatttatatgtaattatagttcttggttttgctttagattatataatgtctctttgttaagatgtgatcatattgccagagaaatgtggttttattgcttgatgttcgccaatgttgagtttgtttttaatgtcgtgtgcctattatagtactacgcggttttggtttacgaagagatttctgttcttgataacggaagtggattactacggtactacctttagaaagttgtttcttatcacatttatatgtaattatagttcttggttgtgctttagatcatatattgtctctttgctaatatgtgatacatattgccatagaaatgtggttgttattgcttgatgttcgcgaatgttgagtttgtttttattgtcgtgtgcctattatagtactacgtggttatttggtttacgaagagatttctattcttgatgatgtttgttctccggatgtgaagctaaatctttgaaaggaaaacaagagttttctaaatatagggaaaagatttgtttggtgatgcaaagatgaaaattgt

SEQ ID NO: 15 - DNA, 996 bp, Arabidopsis
atggcaagactcacgagctttctccttcttctttctctcatctgctttgtccctctctgtctctgcgacaagagctatggaggcaaacttttcccgggttattacgcccattcatgcccacaagtcaatgagatcgtgagatcagttgtagctaaagctgttgctagagagacacgtatggctgcttccttgttgagacttcatttccacgactgtttcgttcagggttgtgatggctctttgcttctagacagcagtggaagggtagcgactgagaaaaactcaaaccctaacagcaaatcagctcgtgggtttgacgtagttgaccaaatcaaagctgaactggagaaacaatgccctggaactgtttcttgcgctgatgttcttaccctagccgctagagactcctctgttcttaccggtggaccaagttgggttgttccattgggaagaagagattcaagaagtgcaagcttgagtcaatcgaacaacaacatccctgcaccaaacaacactttccagaccattctatctaagtttaaccgtcaaggacttgatatcactgaccttgtcgctctctccggtagtcacacaatcggattctcgagatgcacgagtttcagacagaggttgtacaaccagtccggaaacggcagtccagacatgacattggaacaatccttcgctgctaacttgcgccaacggtgtccaaaatccggtggggaccagattctctcggtgctagacatcatcagcgccgcgagcttcgacaacagctacttcaagaacttgatagagaacaaggggttgttgaactcggaccaagttctgttcagcagtaacgagaaatcgagagagcttgtgaagaagtatgcagaagatcaaggagagttttttgagcaatttgcggaatcgatgatcaagatgggaaatatctctcccttgacaggttctagtggcgaaatcaggaagaattgcaggaagattaactcttga

SEQ ID NO: 16 - DNA, 2322 bp, Arabidopsis
atggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatgatggcgtttactgttttcaagatgttgactgctttagtctcttgtgctactgcgattacgcttattactttgattcctctgcttttgaaagttaaagttagagagtttatgcttaagaagaaagctcatgagcttggtcgtgaagttggtttgattttgattaagaaagagactggctttcatgttcgtatgcttactcaagagattcgtaagtctttggatcgtcatacgattctttatactactttggttgagctttcgaagactttagggttgcagaattgtgcggtttggatgccgaatgacggtggaacggagatggatttgactcatgagttgagagggagaggtggttatggtggttgttctgtttctatggaggatttggatgttgttaggattagggagagtgatgaagtgaatgtgttgagtgttgactcgtccattgctcgagctagtggtggtggtggggatgttagtgagattggtgccgtggctgctattagaatgccgatgcttcgtgtttcggattttaatggagagctaagttatgcgatacttgtttgtgttttaccgggcgggacgcctcgggattggacttatcaggagattgagattgttaaagttgtggcggatcaagtaaccgttgcgttagatcatgcagcggttcttgaagagtctcagcttatgagggagaagctggcggaacagaacagggcgttgcagatggcgaagagagacgcgttgagagcgagccaagcgaggaatgcgtttcagaaaacgatgagcgaagggatgaggcgtcctatgcattcgatactcggtcttttgtcgatgattcaggacgagaagttgagtgacgagcagaaaatgattgttgatacgatggttaaaacagggaatgttatgtcgaatttggtgggggactctatggatgtgcctgacggtagatttggtacggagatgaaaccatttagtctgcatcgtacgatccatgaagcagcttgtatggcgagatgtttgtgtctatgcaatggaattaggttcttggttgacgcggagaagtctctacctgataatgtagtaggtgatgaaagaagggtctttcaagtgatacttcatatagttggtagtttagtaaagcctagaaaacgtcaagaaggatcttcattgatgtttaaggttttgaaagaaagaggaagcttggataggagtgatcatagatgggctgcttggagatcaccggcttcttcagcagatggagatgtgtatataagatttgaaatgaatgtagagaatgatgattcaagttctcaatcatttgcttctgtttcctccagagatcaagaagttggtgatgttagattctccggcggctatgggttaggacaagatctaagctttggtgtttgtaagaaagtggtgcagttgattcatgggaatatctcggtggtccctggctcggatggttcaccggagaccatgtcgttgctccttcggtttcgacgtagaccctccatatctgtccatggatccagcgagtcgccagctcctgaccaccacgctcacccacattcgaattctctgttacgtggcttacaagttttattggtagacaccaacgattcgaaccgggcagttacacgtaaactcttagagaaactcgggtgcgatgtaaccgcggtttcctctggattcgattgccttaccgccattgctcccggctcgtcctcgccttctacttcgtttcaagtggtggtgcttgatcttcaaatggcagagatggacggttatgaagtggccatgaggatcaggagtcgatcttggccgttgattgtggcgacgacagtgagcttggatgaagaaatgtgggacaagtgtgcacagattggaatcaatggagttgtgagaaagccagtggtgttaagagctatggagagtgagctccgaagagtattgttgcaagctgaccaacttctctaa

SEQ ID NO: 17 - DNA, 762 bp, Arabidopsis
atggcgacttctcagcaatttttaaaccctacactcttcaaatccttagcttcctcaaacaaaaactcatgtactctctgcccatctcctttcttgcaactcaagtccgcctccacaattttcaattacaaaccacttacttcctcctccgccacgatcatcacacgcgtcgctgcatcatcctccgattcaggcgagtcaataaccagagagactttccacggcctctgcttcgtcttgaaagacaacatcgacaccgatcaaataatccccgccgagtacggcactctcatcccttcgattccagaagatcgcgagaaactcggctctttcgcgcttaacggcttaccaaaattctacaacgaacgtttcgttgttccaggagagatgaaatcaaagtactcagtcatcatcggcggcgataatttcggttgcggatcttcccgcgaacacgctccagtttgtctcggcgcggcgggagctaaagctgtggtggcggaatcgtacgctaggatctttttcaggaactgtgtagctacaggtgagattttcccgttggaatcggaggttaggatttgcgacgagtgcaaaacaggggatgtggtgacaatcgaacacaaggaagacggtagtagtttgctgatcaatcatacgacgaggaaagaatacaaactgaaaccgctcggtgatgccggtccggtgatcgacgccggtggaatcttcgcttatgcaagaaaagccggcatgattccttctgcttga

SEQ ID NO: 18 - DNA, 1731 bp, Arabidopsis
atggcaataaaagagcgatcactagaggaaacaccaacatgggctgttgctgtagtttgcttcgttctccttttcatttccatcatgatcgaatacttcttgcactttattggtcactggtttaagaagaagcacaagaaagctttatctgaagctcttgaaaaggttaaagcagaactgatgcttctgggattcatatcgcttctattggttgtattgcaaacaccagtctccgagatttgcattccaagaaatattgctgcgacttggcatccttgtagcaaccatcaagaaatcgccaaatatggtaaagattatatcgacgatggccgcaaaattcttgaagattttgactccaacgacttttacagtcctcgccgaaatttagccaccaagggttatgacaaatgcgcagaaaaggggaaagtagcattagtatctgcctatggtatccaccagctgcatatattcatctttgtgctcgctgtttttcatgttctctactgcattataacctatgctttaggaaagaccaagatgaagaaatggaagtcatgggagagagagaccaaaacaattgagtaccaatatgccaatgatccagagaggttcagatttgcaagagatacatcgttcggacgtagacatctgaatatatggagcaagtctacctttaccctctggattacatgtttcttcagacagttctttggatcagtgacaaaagtagattatcttacactaagacatggctttattatggcacatttgccagcaggaagtgccgctcgtttcgatttccaaaaatacattgaaagatctttggaacaagatttcacggtggttgtcggtataagcccactgatatggtgcattgctgtcttattcatattgaccaatacacatggatgggactcatatctttggctgcccttccttcccttgattgtgatattgatagtaggagcaaaacttcaaatgataatatcgaaattaggattaaggattcaagaaaaaggagatgtggttaaaggagctcctgtggttgaaccgggcgatgatctcttttggtttggtcgtcctcgtttcattctcttcctcattcacttggttcttttcacgaatgcatttcaactggctttcttcgtttggagcacttacgaattcacactcaaaaactgcttccaccacaaaacagaagacattgcaattaggatcaccatgggggtattaatacaagttctatgcagctacatcactctacctctctatgctcttgttactcagatgggaacatcaatgaggccgacaatattcaacgacagggtagccaatgcattgaagaaatggcaccacacagccaagaaacagacgaaacatggacactcaggatctaacacacctcactcgagccgtcctactacgccaacacatggcatgtcaccggtgcatctcctccacaactacaataaccgcagcctcgaccaacaaaccagcttcactgcttctccttctcctcctagattctctgattatagcggccaaggccatggccatcagcatttcttcgaccctgaatctcagaatcactcttaccaacgtgagatcacagattctgaattcagcaatagtcatcatccccaagttgacatggcaagtcctgttagagaagagaaggagattgttgagcatgtcaaggttgatttgtctgagtttacgttcaagaagtga

SEQ ID NO: 19 - DNA, 1284 bp, Arabidopsis
atggcgattccaaggtttagctctctgttacggtgtagaaaatgggctaaaagtgactggcttgtcgcttctataggatgcgtattgatcgtttttttcctctctttcttcttcgatcccacttcagactctgtcccctccgttgaccgatctcggccaatcatatctcctagcgatctggtcaagctgaagttgtcgagtgtagctaaagagagaggagctttttgtttggatggaagcttgcctgggtaccactttcatgagggttctggatctggctcccaaagctggcttgttcatttggagggtggaggctggtgcaacacagttgcgtcatgttctgctcgagcattgactaaattaggttcttccaactactttgaacaagaagtggcctttcaaggtgttttaagtagtgacccatctcaaaatcctgaattctttaactggaacaaggttgcgataaggtactgtgatggtgcttctttttctggacgccctgaagctgaattcaagaatggcacacggcttttcttccggggccagcttatttgggaggctattattgatgaacttttgtcaatgggcatgtcagatgccaaacaggccatacttacaggatgttctgccggtggcttggcaagtcttatacattgtgactactttcgagatcatcttccaaaagatgcagctgtcaaatgtgtttctgatggaggctactttctcaacgtgcctgatgtccttggaaacccaacaatgaggtctttctatcatgatgttgttaatttgcagggcgtagagaagagcttggatcagaaatgtgtagccaaaacggagccatctaagtgtatgtttcctcaagaattcctgaaaaacataagaactccggtatttcttgtcaatccagcctacgatttttggcagattcaacatgtcttggtaccaacttctgcggatccagataaaagttgggcaaagtgcagactcaatattaaggaatgtgatgccgaacagattaaagttctacacggttttcgcagttctatgatgactgcaattggggaatttcatcagaacaaagatggtgggatgttcatagattcctgctatgctcattgccagacagtcatgtccgtgacatggcactccctgacctcaccaagaatcgaaaataagacaattgcagagtctgtaggtgactggtacttcaacagaaaaccggtgaagctaatcgattgtccatacccgtgcaatccttcttgttacaacatgaatttcacatga

SEQ ID NO: 20 - DNA, 1503 bp, Arabidopsis
atggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctagattcgtttcgcagagaaatcgaaggtcttagctcttatgagccagttattacccctctgtgctcagaaatctccaatggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaa

SEQ ID NO: 21 - DNA, 1626 bp, Medicago
atgtctggaagaaaaccctatgctgttgctcagtatggctgtcttcttgtaactcatgcggtaaagaagacggtagaggaagttgatggaaataaatgtgtatctgattggtttggcaaaggctatatgaaagttgaaagacaaaagaagaaactcatttcaaatcgtgatcgtgtgcgtgcacaagttgaagcaattgacagtaaaactgaaaaggttagagatgttgtgtttgagtggctaaaagaagcagaaatagtcatgcaaaaaatggagaatcttaaattacaatcaaaaccaccatcatggattgaatttaataaattgcaggaaaaaattacagcactaaataagaaatgtaattttgagccattttcaactacaattccaagtttagaacacttctctttaggaaataatttcgagtgtttcaagtcgacggagaaggcttcagatgaacttttggaggcactgcaagatgataattgttgtatgataggattgtacggtaggcgtgactctggtaaaactacgttggtgaaagtaatggaacagaaagtccaatatttgaatatttttgatgagattttatttgtcaatgtgaccaaaaacccaaatatcacagcaatgcaagatgaaattgctgactccttgaatataagatttgatagaaacagtgaagctggaagagcaagaagaatattatccacaatagaagatatggatcgtccaatacttgttatctttgatgatgttcgggcaaaatttgacctacgggatgtaggaattccttctaatagtaatcgatgcaaggtacttttgaccgcacgtcgccaaaaatattgtgacttagtttactgtcaaaggaagattctacttgatcccttatctacagaggaagcttcgacgttgtttgaaaaatattcaggcattctcgaagaggatcactcctcctcatttgacttattgaatgtggcacgtgaaattgcttttgaatgtgatgggttaccaggaaaaatcattaaggcagggtcttccgtaagaagtaaaccaatggaggaatgggaaaaatcactagacaatttgagacattcaactgctcaatgggagatgtttctcagttttagaggggaagatactcgctactcttttacaggtagtctttttcaagctttatcccaagggggattcaagactttcatggatgatgaaggactgcacactggggaccgagtttcaccttgtcttagaaatgcaattgaagcatcaagactttcgattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaatggttatggcaaagacatggctcaacatgaaaaaaaattcggaattgactcggagagagtacaaaaatggaagtcagcattgcttgaagtttctaatttgtccggaatgacttacacgactgggtatgaatatgaatttatccaaaagattgtagaagatgccaataatattaaaagtcgtttgcaaatacgaagcgtatag

SEQ ID NO: 22 - DNA, 1632 bp, Medicago
atggcaccgaacttggtgttattatgtgttagtgtttacctctttgccatcactacaactattattgttgctgaagatccatacaggttcttcaactggaacgttacctatggtgacatttatccacttggtgttcgccaacagggaatacttatcaatggccaattcccaggaccagacattcattctgtgacaaatgataatctcattatcaatgtcttcaacagcttggatgaaccttttctcatttcatggaatggagtccagcagagaaggaactcatacgaagatggagtgtttggaacaacatgtcccattccacctggaaagaacttcacatacatacttcaagtaaaagatcaaattggtagtttctattatttcccatctcttgcattccacaaagctgctggtggttttggaggaattagaattctaagtaggccaagaattcccgttcccttcgatgatcccgctggtgattacactgtcctcattggagattggtacaagtccaaccacacggatttgaaggcccaacttgataacggaaagaagttgcctttccctgatggaattcttatcaatggtcgtgggtctggaggatcatctctcaatgtggagcaaggaaagacttacaggcttagaatatcaaacgtgggattggaaaattcactcaactttcgcatacagaaccacaagatgaagctggtagaagtggaaggaacacacaccctccaaaccacctattcctcccttgacgttcacgtcggtcaatcatactcagttctagtaaccgcagatcaacctagtcaagactattatattgttgtttcctctcgatttaccaatcctgtactcacctccactggaattcttcgctacagcaactctgcaggcccagtttcaggtccaccccccggtggacccaccatccaaatcgactggtccttgaaccaagcccgttctattaggacaaacctgacggcaagtggaccaagaccaaatccgcaaggatcataccattacggcatgataaacttaacgaggacaattgtactatcaagttcagctggacaagttaatgggaaacaaagatacgcaattaacagcgtgtcttatgttgcccccgacactcctcttaagctggctgatttcttcaagatagcaggtgtttaccgtcctggaagcatctctgatagacctagtggtggtggtatttacctcgacacttctgttatgcaaactgactacagaacatttgttgagattgttttccaaaatgacgaagacatccttcagagctatcatctagatggctactctttctttgttgttggtatggatggaggacaatggacaagtgataaaaggaaccagtacaatcttcgagatgcagtttcgcgttccaccactcaggtatatccaaagtcatggactgctatctatgttccacttgacaatgtgggaatgtggaacttgaggtcagaattttgggcacgacaatatcttgggcaacagttttatatgcgtgtatacacaacatcaacatcactcagagatgaataccctattcctaagaatgcattactttgtggtagggcaactggaagacatactcgacccctttga

SEQ ID NO: 23 - DNA, 675 bp, Arabidopsis
atggcggagaaagaagaggatgtgaagcttctaggtttttgggcaagcccttttactcgtagagttgagatggctttcaagctcaaaggcgtgccttacgagtacttggagcaagatatagtgaacaagagccctttgcttctccagataaatccggtttacaagaaggttccggttcttgtctacaaagggaaaatattatccgagtcacatgtgatcctcgaatacatcgaccaaatatggaagaacaatccaattcttcctcaagatccttacgagaaagccatggctttattctgggccaagttcgttgatgaacaggttggaccagtagcttttatgtctgtggcaaaagcagagaagggagtagaggttgcaatcaaggaggctcaagaactctttatgtttcttgagaaggaagtcactggaaaagatttcttcggtggcaaaacaattggatttttggacttggtcgcaggaagtatgatcccgttttgtcttgctcgaggttgggaaggtatgggaattgatatgattccagaggaaaagtttccagagctaaacagatggatcaaaaatttgaaagaaattgagatcgtgagagaatgtattcctcctagagaggaacaaattgagcatatgaagaaagttgtagaaagaatcaaatcagcctaa

SEQ ID NO: 24 - DNA, 264 bp, Arabidopsis
atggcaaacgtctccgctttgctcaccatagctcttctcctttgctccacgctaatgtgcactgcccgccccgaaccggccatctccatctctatcacgactgctgccgatccatgtaacatggagaagaagatagaaggaaaattagatgacatgcatatggtagacgaaaactgtggtgcagacgacgaagattgcttaatgaggaggactttggtcgctcatactgattacatctatacccagaagaagaagcatccttga

SEQ ID NO: 25 - DNA, 3405 bp, Medicago
atggaagcctcttcttcttcttcttgcagatcaagttcaaccacaagtttatgcacctaccatgtctttttgagttttcgaggagaagatacacgcaaaggattcaccgatcatttatgtgctgcccttgaaagaaaagggatcacaacttttaaagatgacaaagaccttgagagagggcaagtcatttcagaaaagctaatcaatgcaataaaagattctatgtttgccatcactattctctcaccagactatgcttcttccacttggtgtttggatgagcttcaaatgatcatggagtgcagcagcaaaaacaacctgcatgttttgccagtcttctatggtgtggatccatctgatgtaaggcatcaaagaggatgctttgaggaagctttcagaaaacatcaagagaaattcggtcaacacagtgacagggttgatagatggagagatgctttcacacaagttgccagttactctggatgggactccaagggccagcatgaggcgtcactagtcgaaaacattgctcaacacatacatagaaagttggttcctaaattgccatcttgtacagagaaccttgttgggattgtttcaaaggtggaggaagtaaacaagttcttaggtatggggttgaatgacgttcgctttataggcatatggggtatgggtggcataggcaagtcaactattgctagagcggtctatgaaacaatccgatgtgaatttgaacttacttgctttctagaaaatgttagagagatatctgagacaaatggtttagttcacttacaaagacaacttctttctcatctgagtataagtaggaatgattttcatgatttgtatgatgggaaaaaaacaatacaaaactctttatgcagaaaaaaggttctacttgttcttgatgatgtgaatgaactaaaccagttggagaatttggttgggaaacaagattggtttggtccgggaagtagagtaataatcacaacaagagacaagcacttgctaatgacacatggagtacataaaacctataaaactggaatgttatgcaaacatgatgcccttgttctcttttgtttgaaagcctttaaaggagataaaccacaagaagggtatttggacttatccaaagaagtggtggactattgtggtggtcttccattggcacttgaggtgttaggttcctatctgtatggaagaaatattgatgtttggcatagtgctgttaaaaaattaagaagttttccccaccctagagtccaagataacctgaaaataagttatgatagtttagataccatggagaaggatatttttctagatattgcttgtttctttaagggaatgaagggagataaagttatagatatattagaaagttgtggctatttccctcaaattggaattcaaattttgattgaaagatcattgataactctagattctgtgaataataaattgggaatgcatgatttgcttcaagaaatgggcagggatattgtatttcaggaatctccaaatgatccttgtagacgtagcaggttgtggtctcaagaggacattgatcgcgtcttgacaaaaaacaagggaactgaagcaattaacagtattgatatgaaattacttcaaccatatgaagcacattggaacactgaagcattctcaaagacaagtcagctaaaatttctcagtttatgtgagatgcaacttcctcttggcctcagttgccttcctagttcattaaaagttcttcactggagagggtgtcctttaaaaactctccctataacaactcaacttgatgaacttgttgacattacattatctcatagcaaaattgaacaactctggcaaggagtaaagtttatggaaaagatgaagtacttgaatttggctttttccaagaacctaaagagattgcctgatttttctggtgttccaaatcttgaaaaattgattcttgaaggctgtgaaggcctaattgaggttcatccatcccttgcacaccacaagaaagttgttctggtgaatttgaaagactgcaaaagtcttaaatctctttcagggaagttggagatgagttccctgaagaagttaattctttcaggcagcagtaaatttaaattccttccagagtttggggaaaaaatggaaaatttatcaatgcttgctttagaaggaacagatataagaaaactgcccttatcacttggaagactagtcggacttactaatttgaacttaaaggactgcaaaagcctggtttgtcttccagataccattcatggattgaattccctcataactctggacatttcaggatgctcaaaactttgtagactgccagatggtttaaaggaaatcaagtgtttggaggaactccatgccaatgatactgctattgatgaactaccttcctccattttttatctagatagtcttaaagttttatcatttgctggttgccaagggccatcgacaacgtcaatgaactggtttcttcccttcaatttgatgtttgggagtcaaccagcttccaatggattcagattaccaagttctgtcatgggattaccttctttggaatatttaaacctaagttattgtaatctttctgaagaatcattcccgaattattttcaccacctatcatctttgaagtctttggatctgactggtaacaattttgttatcataccaagtagcatttctaaactttcaaggcttagatttctttgtctaaattggtgccaaaagcttcaattgttgccagagcttccattaaccatgacacagttgaatgcaagcaattgtgattcactggacactatgaaatttaatccagcaaagctatgcagtctctttgcatcacctagaaaactgtcctacgttcaagaactttacaagagatttgaggatcgttgtctccccacaacaagatttgacatgcttatcccaggggatgaaattccatcttggtttgttcctcaaagatccgtttcctgggcaaaagtacatatccctaataatttccctcaagatgaatgggtaggatttgcattgtgtttcctattagtgagttatgctgacccacctgaattgtgtaagcatgagattgattgttatttgtttgcatctaatggtaagaagttaatcaccaccaggagtttacctcctatggacccatgttatcctcatctttatattctctacatgtccatcgatgaatttcgcgatgaaattctcaaagatgattactggagtgagagtggcattgaatttgtattgaaatgttactgctgtcaatcattgcaagtagtgagttgtggttcccgtttggtttgtaagcaagatgttgaagattggagcaaaatgagtcatttcaacgagagttga

SEQ ID NO: 26 - DNA, 903 bp, Arabidopsis
atggctcaaaaagtggaagcagggggtggcgccggaggagcttcatgggatgatggtatccacgatggcgttagaaaggtgcatgtagggcaaggccaagatggtgtgtcatctatcaaagtcgtgtatgcgaaggactctcaggatattgaaggaagtgaacatggaaagaaaacgttacttggatttgaaacgtttgaggttgatgcagacgactacatagtagcagtgcaagtgacctacgacaacgtgtttggccaagactctgacatcatcacatctattaccttcaatacattcaagggaaaaacatctccaccctatggattggaaacgcaaaagaagtttgtactcaaggacaaaaacggtggtaaacttgttggcttccatggacgcgctggtgaagctttatatgctcttggagcatattttgctacaaccacaactcctgtgactcctgccaaaaaactatctgcaattggtggtgatgaaggaactgcatgggacgacggtgcgtacgatggtgtcaagaaggtgtacgtaggacaaggccaagatgggatatcagccgttaagtttgagtacaacaaaggcgcggagaatatcgtaggaggtgaacatggaaagcctactttactcggattcgaggagtttgagattgactatccaagtgaatacatcaccgcagttgaaggcacctatgataaaatctttgggagtgatggcctaatcataactatgcttaggttcaagactaataaacaaacgtctgctccctttggacttgaagctggcacagccttcgaacttaaagaggaagggcacaagatcgttggcttccatggaaaagccagtgagttgcttcatcagtttggagtccatgtcatgccactcaccaactga

SEQ ID NO: 27 - DNA, 1737 bp, Arabidopsis
atggcagtgacagaagcagaaaatcctcttcttggtgaaatcacttgtggcaccttactacagaagttgcaggaaatctgggatgaggttggggagagtgatgaagaacgagacaaactgcttctacagattgaggaagagtgtctgaatgtttacaaaaagaaagttgagctagccgcaaaatctcgtgcagagcttcttcagactttgtcagatgccactgttgaactttccaatctcacaactgctctcggggaaaaaagctatatcgacattcctgataagacttcaggaacgatcaaagaacaactttctgcaatagcacctgcgcttgaacaactttggcaacagaaagaggaaagggtccgggcattttctgatgtacaatcacagattcagaagatatgtgaggagatcgctggcggattgaacaatggacctcatgtggttgatgagactgacttgtctctaaagagattagatgacttccagaggaaactccaagagctccagaaagagaagagtgataggttacagaaggtgctcgagtttgtgagcacggtgcatgatctatgtgccgtccttcgtttagatttcttaagcactgtcaccgaagttcatccgagcttagatgaggcaaatggtgttcaaaccaagagcattagcaatgaaacacttgcaaggttggctaagactgtcttgactcttaaagaagataaaatgcaaagacttaagaagcttcaagaactagctactcagctaactgatctatggaatctgatggatacttctgatgaggaaagggagctttttgaccatgttacctctaacatttcagcttcagttcatgaagtgactgcctctggtgctctcgcacttgatcttatcgaacaggctgaggtggaagtggataggcttgatcaactgaaatctagcagaatgaaggaaattgcattcaaaaagcaatcagagcttgaggagatatatgctcgtgctcacatagaaataaaaccagaggttgttcgtgagaggatcatgtcgttgattgatgctgggaatactgaacctactgagttactggctgacatggatagccagatcgcaaaggccaaggaggaagcctttagtagaaaagaaattttagaccgtgtagagaaatggatgtcagcttgtgaggaagagagctggctcgaagattacaatcgagatcagaacaggtatagtgcaagccgaggtgcgcatttgaatctcaagagagctgagaaagctcggattctggtcagcaagattactgctatggttgacacgttgattgctaaaacccgggcatgggaagaggagaacagtatgtcctttgagtacgatggagttcctttactcgccatgctagatgaatacactatgcttaggcaagaacgagaagatgagaagcggaggctgaaagaacagaagaagcagcaagaacagccacacacagatcaagaatccgcctttgggtctaaaccaagccctgcaagacccgttagtgccaagaaaccggtgggaacacgagtcaatggaggagggctcaacgaaactcctatgaggcgtttgtctatgaactcaaaccagaacggaagcaagtccaagagagacagtctgaacaagatagcttcaccttcgaacattgtagccaacacaaaagatgatgctgcatctccagtctctcgtgctgacccagtgatggcttcaccgtga

SEQ ID NO: 28 - DNA, 612 bp, Arabidopsis
atgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcagattactgttcgacgcttgaaggtgatgactcttacagttgctggagagcttactttgaactcaaagatctcgaaagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactga

SEQ ID NO: 29 - protein, 331 aa, Arabidopsis
MARLTSFLLLLSLICFVPLCLCDKSYGGKLFPGYYAHSCPQVNEIVRSVVAKAVARETRMAASLLRLHFHDCFVQGCDGSLLLDSSGRVATEKNSNPNSKSARGFDVVDQIKAELEKQCPGTVSCADVLTLAARDSSVLTGGPSWVVPLGRRDSRSASLSQSNNNIPAPNNTFQTILSKFNRQGLDITDLVALSGSHTIGFSRCTSFRQRLYNQSGNGSPDMTLEQSFAANLRQRCPKSGGDQILSVLDIISAASFDNSYFKNLIENKGLLNSDQVLFSSNEKSRELVKKYAEDQGEFFEQFAESMIKMGNISPLTGSSGEIRKNCRKINS

SEQ ID NO: 30 - protein, 773 aa, Arabidopsis
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHIVGSLVKPRKRQEGSSLMFKVLKERGSLDRSDHRWAAWRSPASSADGDVYIRFEMNVENDDSSSQSFASVSSRDQEVGDVRFSGGYGLGQDLSFGVCKKVVQLIHGNISVVPGSDGSPETMSLLLRFRRRPSISVHGSSESPAPDHHAHPHSNSLLRGLQVLLVDTNDSNRAVTRKLLEKLGCDVTAVSSGFDCLTAIAPGSSSPSTSFQVVVLDLQMAEMDGYEVAMRIRSRSWPLIVATTVSLDEEMWDKCAQIGINGVVRKPVVLRAMESELRRVLLQADQLL

SEQ ID NO: 31 - protein, 253 aa, Arabidopsis
MATSQQFLNPTLFKSLASSNKNSCTLCPSPFLQLKSASTIFNYKPLTSSSATIITRVAASSSDSGESITRETFHGLCFVLKDNIDTDQIIPAEYGTLIPSIPEDREKLGSFALNGLPKFYNERFVVPGEMKSKYSVIIGGDNFGCGSSREHAPVCLGAAGAKAVVAESYARIFFRNCVATGEIFPLESEVRICDECKTGDVVTIEHKEDGSSLLINHTTRKEYKLKPLGDAGPVIDAGGIFAYARKAGMIPSA

SEQ ID NO: 32 - protein, 575 aa, Arabidopsis
MAIKERSLEETPTWAVAVVCFVLLFISIMIEYFLHFIGHWFKKKHKKALSEALEKVKAELMLLGFISLLLVVLQTPVSEICIPRNIAATWHPCSNHQEIAKYGKDYIDDGRKILEDFDSNDFYSPRRNLATKGYDKCAEKGKVALVSAYGIHQLHIFIFVLAVFHVLYCIITYALGKTKMKKWKSWERETKTIEYQYANDPERFRFARDTSFGRRHLNIWSKSTFTLWITCFFRQFFGSVTKVDYLTLRHGFIMAHLPAGSAARFDFQKYIERSLEQDFTVVVGISPLIWCIAVLFILTNTHGWDSYLWLPFLPLIVILIVGAKLQMIISKLGLRIQEKGDVVKGAPVVEPGDDLFWFGRPRFILFLIHLVLFTNAFQLAFFVWSTYEFTLKNCFHHKTEDIAIRITMGVLIQVLCSYITLPLYALVTQMGTSMRPTIFNDRVANALKKWHHTAKKQTKHGHSGSNTPHSSRPTTPTHGMSPVHLLHNNNRSLDQQTSFTASPSPPRFSDYSGQGHGHQHFFDPESQNHSYQREITDSEFSNSHHPQVDMASPVREEKEIVEHVKVDLSEFTFKK

SEQ ID NO: 33 - protein, 427 aa, Arabidopsis
MAIPRFSSLLRCRKWAKSDWLVASIGCVLIVFFLSFFFDPTSDSVPSVDRSRPIISPSDLVKLKLSSVAKERGAFCLDGSLPGYHFHEGSGSGSQSWLVHLEGGGWCNTVASCSARALTKLGSSNYFEQEVAFQGVLSSDPSQNPEFFNWNKVAIRYCDGASFSGRPEAEFKNGTRLFFRGQLIWEAIIDELLSMGMSDAKQAILTGCSAGGLASLIHCDYFRDHLPKDAAVKCVSDGGYFLNVPDVLGNPTMRSFYHDVVNLQGVEKSLDQKCVAKTEPSKCMFPQEFLKNIRTPVFLVNPAYDFWQIQHVLVPTSADPDKSWAKCRLNIKECDAEQIKVLHGFRSSMMTAIGEFHQNKDGGMFIDSCYAHCQTVMSVTWHSLTSPRIENKTIAESVGDWYFNRKPVKLIDCPYPCNPSCYNMNFT

SEQ ID NO: 34 - protein, 500 aa, Arabidopsis
MVQYQRLIIHHGRKEDKFRVSSAEESGGGGCCYSKRAKQKFRCLLFLSILSCCFVLSPYYLFGFSTLSLLDSFRREIEGLSSYEPVITPLCSEISNGTICCDRTGLRSDICVMKGDVRTNSASSSIFLFTSSTNNNTKPEKIKPYTRKWETSVMDTVQELNLITKDSNKSSDRVCDVYHDVPAVFFSTGGYTGNVYHEFNDGIIPLFITSQHYNKKVVFVIVEYHDWWEMKYGDVVSQLSDYPLVDFNGDTRTHCFKEATVGLRIHDELTVNSSLVIGNQTIVDFRNVLDRGYSHRIQSLTQEETEANVTALDFKKKPKLVILSRNGSSRAILNENLLVELAEKTGFNVEVLRPQKTTEMAKIYRSLNTSDVMIGVHGAAMTHFLFLKPKTVFIQIIPLGTDWAAETYYGEPAKKLGLKYVGYKIAPKESSLYEEYGKDDPVIRDPDSLNDKGWEYTKKIYLQGQNVKLDLRRFRETLTRSYDFSIRRRFREDYLLHRED

SEQ ID NO: 35 - protein, 541 aa, Medicago
MSGRKPYAVAQYGCLLVTHAVKKTVEEVDGNKCVSDWFGKGYMKVERQKKKLISNRDRVRAQVEAIDSKTEKVRDVVFEWLKEAEIVMQKMENLKLQSKPPSWIEFNKLQEKITALNKKCNFEPFSTTIPSLEHFSLGNNFECFKSTEKASDELLEALQDDNCCMIGLYGRRDSGKTTLVKVMEQKVQYLNIFDEILFVNVTKNPNITAMQDEIADSLNIRFDRNSEAGRARRILSTIEDMDRPILVIFDDVRAKFDLRDVGIPSNSNRCKVLLTARRQKYCDLVYCQRKILLDPLSTEEASTLFEKYSGILEEDHSSSFDLLNVAREIAFECDGLPGKIIKAGSSVRSKPMEEWEKSLDNLRHSTAQWEMFLSFRGEDTRYSFTGSLFQALSQGGFKTFMDDEGLHTGDRVSPCLRNAIEASRLSIIVLSENYANSTWCLDELVKILECKKWNNQLVWPIFYKVEPSDIRHLRNGYGKDMAQHEKKFGIDSERVQKWKSALLEVSNLSGMTYTTGYEYEFIQKIVEDANNIKSRLQIRSV

SEQ ID NO: 36 - protein, 543 aa, Medicago
MAPNLVLLCVSVYLFAITTTIIVAEDPYRFFNWNVTYGDIYPLGVRQQGILINGQFPGPDIHSVTNDNLIINVFNSLDEPFLISWNGVQQRRNSYEDGVFGTTCPIPPGKNFTYILQVKDQIGSFYYFPSLAFHKAAGGFGGIRILSRPRIPVPFDDPAGDYTVLIGDWYKSNHTDLKAQLDNGKKLPFPDGILINGRGSGGSSLNVEQGKTYRLRISNVGLENSLNFRIQNHKMKLVEVEGTHTLQTTYSSLDVHVGQSYSVLVTADQPSQDYYIVVSSRFTNPVLTSTGILRYSNSAGPVSGPPPGGPTIQIDWSLNQARSIRTNLTASGPRPNPQGSYHYGMINLTRTIVLSSSAGQVNGKQRYAINSVSYVAPDTPLKLADFFKIAGVYRPGSISDRPSGGGIYLDTSVMQTDYRTFVEIVFQNDEDILQSYHLDGYSFFVVGMDGGQWTSDKRNQYNLRDAVSRSTTQVYPKSWTAIYVPLDNVGMWNLRSEFWARQYLGQQFYMRVYTTSTSLRDEYPIPKNALLCGRATGRHTRPL

SEQ ID NO: 37 - protein, 224 aa, Arabidopsis
MAEKEEDVKLLGFWASPFTRRVEMAFKLKGVPYEYLEQDIVNKSPLLLQINPVYKKVPVLVYKGKILSESHVILEYIDQIWKNNPILPQDPYEKAMALFWAKFVDEQVGPVAFMSVAKAEKGVEVAIKEAQELFMFLEKEVTGKDFFGGKTIGFLDLVAGSMIPFCLARGWEGMGIDMIPEEKFPELNRWIKNLKEIEIVRECIPPREEQIEHMKKVVERIKSA

SEQ ID NO: 38 - protein, 87 aa, Arabidopsis
MANVSALLTIALLLCSTLMCTARPEPAISISITTAADPCNMEKKIEGKLDDMHMVDENCGADDEDCLMRRTLVAHTDYIYTQKKKHP

SEQ ID NO: 39 - protein, 1134 aa, Medicago
MEASSSSSCRSSSTTSLCTYHVFLSFRGEDTRKGFTDHLCAALERKGITTFKDDKDLERGQVISEKLINAIKDSMFAITILSPDYASSTWCLDELQMIMECSSKNNLHVLPVFYGVDPSDVRHQRGCFEEAFRKHQEKFGQHSDRVDRWRDAFTQVASYSGWDSKGQHEASLVENIAQHIHRKLVPKLPSCTENLVGIVSKVEEVNKFLGMGLNDVRFIGIWGMGGIGKSTIARAVYETIRCEFELTCFLENVREISETNGLVHLQRQLLSHLSISRNDFHDLYDGKKTIQNSLCRKKVLLVLDDVNELNQLENLVGKQDWFGPGSRVIITTRDKHLLMTHGVHKTYKTGMLCKHDALVLFCLKAFKGDKPQEGYLDLSKEVVDYCGGLPLALEVLGSYLYGRNIDVWHSAVKKLRSFPHPRVQDNLKISYDSLDTMEKDIFLDIACFFKGMKGDKVIDILESCGYFPQIGIQILIERSLITLDSVNNKLGMHDLLQEMGRDIVFQESPNDPCRRSRLWSQEDIDRVLTKNKGTEAINSIDMKLLQPYEAHWNTEAFSKTSQLKFLSLCEMQLPLGLSCLPSSLKVLHWRGCPLKTLPITTQLDELVDITLSHSKIEQLWQGVKFMEKMKYLNLAFSKNLKRLPDFSGVPNLEKLILEGCEGLIEVHPSLAHHKKVVLVNLKDCKSLKSLSGKLEMSSLKKLILSGSSKFKFLPEFGEKMENLSMLALEGTDIRKLPLSLGRLVGLTNLNLKDCKSLVCLPDTIHGLNSLITLDISGCSKLCRLPDGLKEIKCLEELHANDTAIDELPSSIFYLDSLKVLSFAGCQGPSTTSMNWFLPFNLMFGSQPASNGFRLPSSVMGLPSLEYLNLSYCNLSEESFPNYFHHLSSLKSLDLTGNNFVIIPSSISKLSRLRFLCLNWCQKLQLLPELPLTMTQLNASNCDSLDTMKFNPAKLCSLFASPRKLSYVQELYKRFEDRCLPTTRFDMLIPGDEIPSWFVPQRSVSWAKVHIPNNFPQDEWVGFALCFLLVSYADPPELCKHEIDCYLFASNGKKLITTRSLPPMDPCYPHLYILYMSIDEFRDEILKDDYWSESGIEFVLKCYCCQSLQVVSCGSRLVCKQDVEDWSKMSHFNES

SEQ ID NO: 40 - protein, 300 aa, Arabidopsis
MAQKVEAGGGAGGASWDDGIHDGVRKVHVGQGQDGVSSIKVVYAKDSQDIEGSEHGKKTLLGFETFEVDADDYIVAVQVTYDNVFGQDSDIITSITFNTFKGKTSPPYGLETQKKFVLKDKNGGKLVGFHGRAGEALYALGAYFATTTTPVTPAKKLSAIGGDEGTAWDDGAYDGVKKVYVGQGQDGISAVKFEYNKGAENIVGGEHGKPTLLGFEEFEIDYPSEYITAVEGTYDKIFGSDGLIITMLRFKTNKQTSAPFGLEAGTAFELKEEGHKIVGFHGKASELLHQFGVHVMPLTN

SEQ ID NO: 41 - protein, 578 aa, Arabidopsis
MAVTEAENPLLGEITCGTLLQKLQEIWDEVGESDEERDKLLLQIEEECLNVYKKKVELAAKSRAELLQTLSDATVELSNLTTALGEKSYIDIPDKTSGTIKEQLSAIAPALEQLWQQKEERVRAFSDVQSQIQKICEEIAGGLNNGPHVVDETDLSLKRLDDFQRKLQELQKEKSDRLQKVLEFVSTVHDLCAVLRLDFLSTVTEVHPSLDEANGVQTKSISNETLARLAKTVLTLKEDKMQRLKKLQELATQLTDLWNLMDTSDEERELFDHVTSNISASVHEVTASGALALDLIEQAEVEVDRLDQLKSSRMKEIAFKKQSELEEIYARAHIEIKPEVVRERIMSLIDAGNTEPTELLADMDSQIAKAKEEAFSRKEILDRVEKWMSACEEESWLEDYNRDQNRYSASRGAHLNLKRAEKARILVSKITAMVDTLIAKTRAWEEENSMSFEYDGVPLLAMLDEYTMLRQEREDEKRRLKEQKKQQEQPHTDQESAFGSKPSPARPVSAKKPVGTRVNGGGLNETPMRRLSMNSNQNGSKSKRDSLNKIASPSNIVANTKDDAASPVSRADPVMASP

SEQ ID NO: 42 - protein, 203 aa, Arabidopsis
MIKSVTLRSFHLPIEFNDTKFVSRPCFLARSFPVVRCSSTRDVPKLELFSRGKFDRILQDPPLIEKAESELSDYCSTLEGDDSYSCWRAYFELKDLEREKPKVEVENLILQTGGLKSLIGCLHGVASMEKDNKTKNGLHVGEESDREKGMNLHIHIPDGLPKSEQELEEEEKSKMPDSAFTRLLRSKGTIPAWFSHAPDHETD

SEQ ID NO: 43 - DNA, 1518 bp, Arabidopsis
atcactcaccacaaagtcttctcatttcctcatcttcttgttgaaagtaatggcaagactcacgagctttctccttcttctttctctcatctgctttgtccctctctgtctctgcgacaagagctatggaggcaaacttttcccgggttattacgcccattcatgcccacaagtcaatgagatcgtgagatcagttgtagctaaagctgttgctagagagacacgtatggctgcttccttgttgagacttcatttccacgactgtttcgttcaggtttagttaatttcttttacgtttcaacattttatgttgttttaagtttacttgctaaacaaggtaactgtgaaatgtagggttgtgatggctctttgcttctagacagcagtggaagggtagcgactgagaaaaactcaaaccctaacagcaaatcagctcgtgggtttgacgtagttgaccaaatcaaagctgaactggagaaacaatgccctggaactgtttcttgcgctgatgttcttaccctagccgctagagactcctctgttcttgtaagtttcctccacaatctctattttctcgaaccaaaactgaaacatcagctaactcggttggtttttggtttagaccggtggaccaagttgggttgttccattgggaagaagagattcaagaagtgcaagcttgagtcaatcgaacaacaacatccctgcaccaaacaacactttccagaccattctatctaagtttaaccgtcaaggacttgatatcactgaccttgtcgctctctccggtaagctttcgtcactctatcacagtttcttgcttcacacacatggaacacaattaaaaaaaatccattatacattacttgcttctcaagccaccacacttctcaaatgttatctcaggtagtcacacaatcggattctcgagatgcacgagtttcagacagaggttgtacaaccagtccggaaacggcagtccagacatgacattggaacaatccttcgctgctaacttgcgccaacggtgtccaaaatccggtggggaccagattctctcggtgctagacatcatcagcgccgcgagcttcgacaacagctacttcaagaacttgatagagaacaaggggttgttgaactcggaccaagttctgttcagcagtaacgagaaatcgagagagcttgtgaagaagtatgcagaagatcaaggagagttttttgagcaatttgcggaatcgatgatcaagatgggaaatatctctcccttgacaggttctagtggcgaaatcaggaagaattgcaggaagattaactcttgattgaaacaagaaaactcttcttatatcttgtggaacaaatgtgagacatttacttttactttggagtgtgttttgtttgtttttttcaattctgtcatttggaagttttatttcgtgttatttgcgttgtgttaagacataagtttgaaatttataaaacttgtacgaggaaatattttgaaattataaactttaaact

SEQ ID NO: 44 - DNA, 3073 bp, Arabidopsis
atacatacacttctctttttatcctccatcggcggcttatggcggttttccggcactaatcatctccggcatatataaataaacgtacttcacgtttttttatataacttcaaagtagtttcagatttgtctctatctcttcacttttaagtcttctggttttgtcatcaccagctttttttgttctgtctctgtctttctctttgtgtatttttattctcgtcatcgttgttcttctatgagaggaagatcggaatgtcgaagagaattagaagattctcgtacatcacttcgttggaatttcacaggtcgatgagagatctgagaactgtttcattttgatccaaactcatctctttcaggtattccaaatttttctttctctgttctttctactattacccaaattaaagttttgatttttatttctcactctgtttcttgtttttctaattgcagagtataatggactaagcattttttttctccgaagatggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatgatggcgtttactgttttcaagatgttgactgctttagtctcttgtgctactgcgattacgcttattactttgattcctctgcttttgaaagttaaagttagagagtttatgcttaagaagaaagctcatgagcttggtcgtgaagttggtttgattttgattaagaaagagactggctttcatgttcgtatgcttactcaagagattcgtaagtctttggatcgtcatacgattctttatactactttggttgagctttcgaagactttagggttgcagaattgtgcggtttggatgccgaatgacggtggaacggagatggatttgactcatgagttgagagggagaggtggttatggtggttgttctgtttctatggaggatttggatgttgttaggattagggagagtgatgaagtgaatgtgttgagtgttgactcgtccattgctcgagctagtggtggtggtggggatgttagtgagattggtgccgtggctgctattagaatgccgatgcttcgtgtttcggattttaatggagagctaagttatgcgatacttgtttgtgttttaccgggcgggacgcctcgggattggacttatcaggagattgagattgttaaagttgtggcggatcaagtaaccgttgcgttagatcatgcagcggttcttgaagagtctcagcttatgagggagaagctggcggaacagaacagggcgttgcagatggcgaagagagacgcgttgagagcgagccaagcgaggaatgcgtttcagaaaacgatgagcgaagggatgaggcgtcctatgcattcgatactcggtcttttgtcgatgattcaggacgagaagttgagtgacgagcagaaaatgattgttgatacgatggttaaaacagggaatgttatgtcgaatttggtgggggactctatggatgtgcctgacggtagatttggtacggagatgaaaccatttagtctgcatcgtacgatccatgaagcagcttgtatggcgagatgtttgtgtctatgcaatggaattaggttcttggttgacgcggagaagtctctacctgataatgtagtaggtgatgaaagaagggtctttcaagtgatacttcatatagttggtagtttagtaaagcctagaaaacgtcaagaaggatcttcattgatgtttaaggttttgaaagaaagaggaagcttggataggagtgatcatagatgggctgcttggagatcaccggcttcttcagcagatggagatgtgtatataagatttgaaatgaatgtagagaatgatgattcaagttctcaatcatttgcttctgtttcctccagagatcaagaagttggtgatgttagattctccggcggctatgggttaggacaagatctaagctttggtgtttgtaagaaagtggtgcaggtgagtttccttacatatctctttctaaagttcctgtcattagtctgagtttctgtttaggagttctttgataatgtgtgcagttgattcatgggaatatctcggtggtccctggctcggatggttcaccggagaccatgtcgttgctccttcggtttcgacgtagaccctccatatctgtccatggatccagcgagtcgccagctcctgaccaccacgctcacccacattcgaattctctgttacgtggcttacaagttttattggtagacaccaacgattcgaaccgggcagttacacgtaaactcttagagaaactcgggtgcgatgtaaccgcggtttcctctggattcgattgccttaccgccattgctcccggctcgtcctcgccttctacttcgtttcaagtggtggtgcttgatcttcaaatggcagagatggacggttatgaagtggccatgaggatcaggagtcgatcttggccgttgattgtggcgacgacagtgagcttggatgaagaaatgtgggacaagtgtgcacagattggaatcaatggagttgtgagaaagccagtggtgttaagagctatggagagtgagctccgaagagtattgttgcaagctgaccaacttctctaagttgttatctcaacttctcttctacattcaaaatttttacaccatagatttatgtcaaatatatcaaaatgaaatttcgaaattgttattatatataccacccatatctctatgatttgtacatcctgtttttttttgttctttttctcattttgaaccccacgaaattgcattg

SEQ ID NO: 45 - DNA, 3859 bp, Arabidopsis
ttaagaagtagcagaacaatggcgacttctcagcaatttttaaaccctacactcttcaaatccttagcttcctcaaacaaaaactcatgtactctctgcccatctcctttcttgcaactcaagtccgcctccacaattttcaattacaaaccacttacttcctcctccgccacgatcatcacacgcgtcgctgcatcatcctccgattcaggcgagtcaataaccagagagactttccacggcctctgcttcgtcttgaaagacaacatcgacaccgatcaaataatccccgccgagtacggcactctcatcccttcgattccagaagatcgcgagaaactcggctctttcgcgcttaacggcttaccaaaattctacaacgaacgtttcgttgttccaggagagatgaaatcaaagtactcagtcatcatcggcggcgataatttcggttgcggatcttcccgcgaacacgctccagtttgtctcggcgcggcgggagctaaagctgtggtggcggaatcgtacgctaggatctttttcaggaactgtgtagctacaggtgagattttcccgttggaatcggaggttaggatttgcgacgagtgcaaaacaggggatgtggtgacaatcgaacacaaggaagacggtagtagtttgctgatcaatcatacgacgaggaaagaatacaaactgaaaccgctcggtgatgccggtccggtgatcgacgccggtggaatcttcgcttatgcaagaaaagccggcatgattccttctgcttgaatgtaatcggatccataatttatcggttctgagtttaatccggtttggtttatttggttcgagaaccggtactaacgaaataaattattaccaaaccaaaatttcttctggttcgactttgtttgccacgtggaaacagcgatataaacaagtgcccaaaaaggcttgcaatggtttttgtacaagaccttcgttttcttcaatgttcctcttttcttagatgcatttgcatgtcctctcgaactgaaagtttaaggttcttcttctgccttcgcatctgtactaaggttggtttcgaagatttctcatctctttcaattgtaattcttatcacatatactctatctgttgtataattctgtttctgttgaagttaagtgtgtttatctccgctttgaaactccttttcctgtttgtattattttgcagtgggtgaatgttagttgaatttgtggtttgaagtctcaattgaaattaactgagtagtgaaaggggttttctagggtttgacaagaggatggataggattagcaatctaccaaatgagatcatttgtcacattgtatctttcctttcggcaaaggaagctgctttcgcatcgattctgtcaaagaggtggcggaatctctttaccattgtaataaaacttcagtttgatgactcagtcaagaatgaagggagtttgaaggattttgtcgatggagtattggctctgcctaccagttctcgtgtaaggagttgctctctagaatgtcgaagagagtttgatccgactcattatgatgatttcaatcgttgtatatgtgctttgctgaagcgtggtatcttggatcttaaactagacatatgtgctgggagacgatattcactaccacttgaggttttcacttgcaaaacactcgttaagctggaacttgggagtgattttggtggctttgttgttgatcttgtccctgaggatgcttttctaccagcgcttgagaccctccttcttaactatattcggtttaaagatctccgccgttgtgcgtttgaaaagcttctttctgcttgccttgtgctcaaggaactagtcatacataatatggagtgggaacgttggaaatggtctggcaacatatccagtccaacccttgaaagacttactattagtcatgtagatctctatgagtgtgagtttacgagaataaatttagatactccgaatcttacctatttagagttgtctgatgctgtaccggatgactatccaattgttaatcttgactcccttgttgaagttaagctcgatcttacgttgatggtagatcacaagtaccatggatatgtagatgacaacgacacgatttctagcaatccaacaaatctgattaatgggttaagaaatgttgaaatcatgaacttgcaatctcctaatacttttcaggttagtgtgctattgtttcttctttctctgtaacatgttattacagtttgagtttgattaaaacaaaaatatgaagaatcaaaatcgttttaacattcaggtgtgcatcttaggtttcttaagatgttccagttctcttgttacataaatgaaaatatatcctagaggtcgtcttcatccaaatatatacatataatgaatgactaattgatttattttgtttcaggcattttcttacttccatgaagcaataccggtgtttaaaaacctttatcatttaactatcacaaataatgatactgtaattgggttctgttgggaatttctaccatttgtgataaagaagtgtccaaatctaaagactcttgtcatcgatgtacgatcaatacccaaaagtttattgtacaaatgcaataaaaccttgtagatactccttgattttcagtttctaatattttctcttgttgagttgcttcagggtccattgcactacaatgaagaccgacccaaatctgtttgccactgtttgtcgggatattctttcttattgtcatgtcctttagaggtcttacagataaccgactatagtggaactcctggagaggtggagcaattgaagcattttctagagaaactgtccggtctcaagttggtgaaacttcattctcttacaagatttggtagcgacaagaaaaagttattaatgcttcccagagcttcctctaagtgcaagatcaaggtcacgttttcttaaaagctttgatcctcctagttgcaatctatctgttgtatcattttggatagtgaacactcttactcacttatatcctctgtttatcttttgtcggattctccttgttgtcctattttgaacttatcaactttctggagcctgttttgattcgcttttcatttgtaatttgctttgatagattcttaggaaactgtaaaatgaaactcagtatgtatattattaggcgtggataattctaaaagcctaaaattttcctttttggtttcttattacacaaggtacaagttctagagtgattgggaattgaattttgctctgtagtaaagtatgtgtcagggttttataatctcttttgcaacttatttttgcttcttgtccttataccttcggtttatgtcttctttttttgagacatatactgattctttttaaagcattatgattctctagagaatgctcttcttccatcgctcaagactctcattcttgattcagttaagttctatgatcgttgtggttgttgtgcattccaaaagcttctttctgcttgccctgtgcttgtggaatcagtgatgcgtaatctggaatgggaagattgggaatggtctggctgtgcgtccagtcaaacccttgagagacttactattgaccatagatattgggctgaacataacttggagagctttacttttgatactccgagtcttacctacttagactacaatgctcatgttccgggatcgtatccaactgttaatcttgactcccttgtcgaggctaagctcaatcttggttttacaactgatcttgtagaagatgatgacgatccctttaccagcgatccaaccaatctaatcaaagggttaagaaatgttgagatcttgagactatggatgtaa

SEQ ID NO: 46 - DNA, 3666 bp, Arabidopsis
ttgagcagtgaaattaatggcaataaaagagcgatcactagaggaaacaccaacatgggctgttgctgtagtttgcttcgttctccttttcatttccatcatgatcgaatacttcttgcactttattggtcacgtacgtatatttttcatttttatatttccaaatcttcctttctctctttttgcttttctccaaatgatacgaaagtacacattaatttagtactattacttttgcattttaaggttattaatgcatcatctcgctttttcttaactaggcaatcaaaatttattcggtataaccccataattaatctctaattcttcttttcacttattgtagtggtttaagaagaagcacaagaaagctttatctgaagctcttgaaaaggttaaagcaggcaagttaattcactattctataaaaagttgtcatcaaagacgactttttatattacaatatgataaatctttctctatttggattcccaactaactttcttcttttgttgttggattgtgatgaaaatagaactgatgcttctgggattcatatcgcttctattggttgtattgcaaacaccagtctccgagatttgcattccaagaaatattgctgcgacttggcatccttgtagcaaccatcaagaaatcgccaaatatggtaaagattatatcgacgatggccgcaaaattcttgaagattttgactccaacgacttttacagtcctcgccgaaatttagccaccaagggttatgacaaatgcgcagaaaaggcatgtaattcataattacttactaactatactagtatgccgcttttatgtttagcaaatatatatatcggaatcttatttcatattttcgatttcaggggaaagtagcattagtatctgcctatggtatccaccagctgcatatattcatctttgtgctcgctgtttttcatgttctctactgcattataacctatgctttaggaaagaccaaggtacatgatcttctctatacattttgtacaagtttatgcatatatttgtatgtgtttaatttgttttttaatctatatatggttatgcaatatgtagatgaagaaatggaagtcatgggagagagagaccaaaacaattgagtaccaatatgccaatggtatgtacatatacaacacacactatctcatcgccatagagtttatatttgtagaagtaattaatcaaagaaaaatgactaataatccggtagttgactttgccaaggttaacatcttgatagcgtatcagtgggaagataattgtttatttcattgattagtttgtttatttgattgagttagataattgaattgttgattaattacaacgtcgtttgtttgactcacgaataaacaatttaacacaagaaagtaacatcatattttatttttatttaactatatattatctgtcctctgatttaatttgtttagttcaattggttatttaactattatagatccagagaggttcagatttgcaagagatacatcgttcggacgtagacatctgaatatatggagcaagtctacctttaccctctggattgtaagttttcatttctttactttttgtgagtaatttttttatatataatttggttaaaaattgacaacaaaacttatggatggaaatggaatgcagacatgtttcttcagacagttctttggatcagtgacaaaagtagattatcttacactaagacatggctttattatggtaagtaataattagcatatactactagtaatacactatgaattgttgattaattactccaattggtgaattggtgcaggcacatttgccagcaggaagtgccgctcgtttcgatttccaaaaatacattgaaagatctttggaacaagatttcacggtggttgtcggtataaggtacagtatgtcccattttttatttttatttaaaccaagtttgttaatattttgttcaaacaatcttgcacaaaagttaaatatctgattaaatatctttgtgtgaatgcagcccactgatatggtgcattgctgtcttattcatattgaccaatacacatggtatgtcctaattctctaacaattcatttaagagattaagcaaatcgttatatatcaacgaaatatctttctaaatttcaatgtctttttcaaattaaaataggatgggactcatatctttggctgcccttccttcccttgattgtaagtaataaaaaatttcacttcaaagtcttcagtgtattaattatgtagctgtgaataaacaataattgtatatggttggtgtaaatattgaaggtgatattgatagtaggagcaaaacttcaaatgataatatcgaaattaggattaaggattcaagaaaaaggagatgtggttaaaggagctcctgtggttgaaccgggcgatgatctcttttggtttggtcgtcctcgtttcattctcttcctcattcacttggttcttttcacggtacacttatttacttttttacatttaccatcttaagttttttttttgtcaacccttttcttatgactttctaaattttgtttcttctatgtattttgtttatagaatgcatttcaactggctttcttcgtttggagcactgtgagcaataacaatccattttcttcttccaatttatatatgtttttgaaaaaaaattaatgattttggttatgaattaattttgcagtacgaattcacactcaaaaactgcttccaccacaaaacagaagacattgcaattaggatcaccatggggtttgttaacttcctcaactatacataacatacaacaaaataatattatcttttgtatgttttgaaccttaacgataaatttcttcttgttgtatacggcagggtattaatacaagttctatgcagctacatcactctacctctctatgctcttgttactcaggtacaacttttaacaaattttaaattgctaagtgtcaatgcgtcatgtttgaaacaattaagggtttgctacaaaattgtgattgtcccatatatagtttagattattttggatgtataggatttctctaacactaaaatgtgattgcagatgggaacatcaatgaggccgacaatattcaacgacagggtagccaatgcattgaagaaatggcaccacacagccaagaaacagacgaaacatggacactcaggatctaacacacctcactcgagccgtcctactacgccaacacatggcatgtcaccggtgcatctcctccacaactacaataaccgcagcctcgaccaacaaaccagcttcactgcttctccttctcctcctagattctctgattatagcggccaaggccatggccatcagcatttcttcgaccctgaatctcagaatcactcttaccaacgtgagatcacagattctgaattcagcaatagtcatcatccccaagttgacatggcaagtcctgttagagaagagaaggagattgttgagcatgtcaaggttgatttgtctgagtttacgttcaagaagtgataggactatactttttacattctgtttgttcattctttgtaaatgatatgaacttaggaatgaacacttttcttatttctttatctgaattttgctataagctcaaa

SEQ ID NO: 47 - DNA, 6209 bp, Arabidopsis
gatctcttcctttgattcttcttctaatcttcttcaatggcgattccaaggtttagctctctgttacggtgtagaaaatgggctaaaagtgactggcttgtcgcttctataggatgcgtattgatcgtttttttcctctctttcttcttcgatcccacttcagactctgtcccctccgttgaccgatctcggccaatcatatctcctagcgatctggtcaagctgaagttgtcgagtgtagctaaagagagaggagcttgtaactgttactaatcctctcgttttttttttgtcttacacttttgcaagtttggatttttaactgaaattgattcaattgcgcagtttgtttggatggaagcttgcctgggtaccactttcatgagggttctggatctggctcccaaagctggcttgttcatttggaggtatttgtcttttcttttgtattgattgaatttaaatataatgagtttagatggggatgagaatatatttgagtgaaagggtggaggctggtgcaacacagttgcgtcatgttctgctcgagcattgactaaattaggttcttccaactactttgaacaagaagtggcctttcaaggtgttttaagtagtgacccatctcaaaatcctggtacgagatatctctagtagcttttacattgttgtcttttatagttgacaatcttctagtatgaattaattaggtagtcttttttttgttttgtgcagaattctttaactggaacaaggttgcgataaggtactgtgatggtgcttctttttctggacgccctgaagctgaattcaaggtaataataaggcttttggtttcgaggatttgcgtcagattttgttgaaagcaattcaagttcaatagtttcatgtttagtttactctctttttccctcttcttagaatggcacacggcttttcttccggggccagcttatttgggaggctattattgatgaacttttgtcaatgggcatgtcagatgccaaacaggtaacgtcttcatgatcttataaaaatggatctgttaataatgttcttctggttaccatgaaagtctgtcttgcactccaatatccatctatgttaacaagacctaccatatatcttctgcatttagttgaattcgcctacttaggtaatttgctacagattaatttttgttcttctttgtaatttgagtaaatgtaggccatacttacaggatgttctgccggtggcttggcaagtcttatacattgtgactactttcgagatcatcttccaaaagatgcagctgtcaaatgtgtttctgatggaggctactttctcaacgtgtatgtttgtgctcatattcattttctcatgattttttttttgacagattcatgagttccactgctctttcttttagttttttgggtctaaactagttttaagaagcacacatgttagatttttagcagactatatactccacagagctaagaagttactgttgatgtgaaacaagctcacactgtctctcagtctcagtaaagctattttccttcatttcaggcctgatgtccttggaaacccaacaatgaggtctttctatcatgatgttgttaatttgcaggttccattcactttctttcaatagtcgaaataatactttgtgatatatcttgaattcttcatcgaaatgagtaagaacatatcatggggttttccattggttctgtgctgggttgctgcggttgataccaaccagggcgtagagaagagcttggatcagaaatgtgtagccaaaacggagccatctaaggtaggttttgtctcttactttgattgtattttccatctactgataaaatcgttctttacctgattatgattggtatttgagactttttttttaaaatttgcagtgtatgtttcctcaagaattcctgaaaaacataagaactccggtatttcttgtcaatccagcctacgatttttggcaggttagagttgccaatccaagcatgagcagcacttattgcctgcttccattagatttgactccaattcatgtttactgttttactaataccaaacatacattcagattcaacatgtcttggtaccaacttctgcggatccagataaaagttgggcaaagtgcagactcaatattaaggaatgtgatgccgaacagattaaagttctacacggtaatttactccttaataaaaataaatgatgccaaacaaggatgagcaaattgatcttgtaacctgattatcaaaagtatcctctgtttcaaagtacaatcagtagatatgagcaagctgtgaagcagctataagatacaagatacaagttgttgaatatttatatgaatcataagatcttcctcggagcataagttaatacggccagctctatttatataaatcctatttaatttacaggttttcgcagttctatgatgactgcaattggggaatttcatcagaacaaagatggtgggatgttcatagattcctgctatgctcattgccagacagtcatgtccgtgacatggcactccctgacctcaccaagaatcgaaaataaggtaaaagatatttaacatgttgcttgttcttacaaatgacctcacctgtttcgtgtctgttttttccgttgttcttgtgggaacagacaattgcagagtctgtaggtgactggtacttcaacagaaaaccggtgaagctaatcgattgtccatacccgtgcaatccttcttgttacaacatgaatttcacatgaacttgccttatatcctcattttaccacttcctctgcttgtggactttttcgattctccagaagcttcttcagcaagggagcagtcacttcctcaaaattctcaatccgggtgagtcctaaaagttttgtacttgttaaatctctaataagtttacaaaattctaggacaatatttgcgaaacaacaaagatggacaattatggaatatttagctaagttttttcgggtcattaatgatgtgatttgatttagattttaatccattgtaacggttaataaaatctttttttcaggaccagtctgtataatttttgacgtaatccggtggtaagacccagatgtcggttgtatgtgtacctgcttatttcacctgcaaatatcagagaaaacacattcaagtttagtgttaggattttcgaaaacccccagtaattaatgttttatcccaaaatgtcaccttttccagctcctccttcactaactgctcctttttcgctgttacccgattgtcaagggcaagatacgctacatagaattttaaatcgacgaaaacttaagcatcatcattcaagaatttaaatataaagatcgtaaaatacaatcttttcagtctctctattaaaatatatattattattattaagatcctcggtttccttggggcataagttagatctttggtctataagatacaactagctagatcctcggttttctttggtctataagatacaactagatctttggtcaataagatacaactagatttttcaaacgtacagttaatcactgagaaacttccttacaagttacaaaagcaacacaaatatcaccattttacatactactgctcacttcctttgcttctgttcttcaatggtgattcgctctctgctacaatgcagaacatggtctaagagtgactggcttctcgcttcaatcggaatagtcttgatcgtttattccttttctttgtccttcaattcaacttcagactctatcccctccgttgaccgtagcgatctagttaaactgaagctgtcgagtaaagctaaagagagaggagcttgtactgtatcatctccaatactttctttttttttaactttcggagtatttatatactatgtttcgcagtttgcttagatggaagcttacctggttatcactttcataagggttcaggatctggctccaatagctggcttctttatttagaggtattcttatttgtcgactgaatttgaatttatttctacttgggagttagaagatattacagtgagattttataaaagggtggaggcgggtgccgtacaattgagtcatgttctgctagagcaatgactaggttaggttcttccaacttctttgaacatgaagtgcctttttttggcgttttaagcagtgacccatctcaaaaccctggtacattacgagaaatctttagtagcttctccgttgttgcttttgtatatatatatggtagtttctttgaagatctatatagttgtctttgttgtttgtttgtagacttctttaactggaacagagttatgatacggtactgtgatggtgcttgtttttctggacaccctgaagctgaattcaaggtaataaggcttttggtcggatgatagccaaaaaaattgactagttttcatgattctttgactctctttctttcgtctcagaatgaaacacggcttttcttccgcggccagctcatttgggaggctatcatggatgaattgttgtcgatgggcatgtcacatgcgaaacgtgtaccgtcctcattatcttataaatcttaatttgtagaacttaagtctctgtcttgaaatcccattaatgtttctttttgttttacatgtttgataaattgcaggccatgctcacaggatgttctgctggtggcttgtctactctaatacattgtgactactttcgagaccatctgcctaaagatgcaactgttaaatgtgtttccgatggaggctatattcttaatgtgtatgtaacttccttttatcacaagtcatgactttaccttttcagtgctctttcattaattccttcaatgaagctggtgatactcccacagagctaaggaaaagcagctaacaatgactatcaacaaaagctattttccttcactttcaggcttgatgtccttggaaacccaacaatgggatctttctttcatgatgttgttaccctgcaggtttgtattcactttctgtcaatattatcttgaataagtcttcattgaaataatcaagaacatgtcatggttttgggttggattgctgcggttgacaccgaccagagcgtagataagagcttggatcagaattgtgttgccaaaatggaaccatctaaggtagcttttgtctcttccttcgaaaaatctttcgtgcctaattatgattggtactgaggcttcttgatttcggtttccagtgtatgtttcctcaagaatctcttaaaaacataagaactccggtatttcttgtcaacacagcctacgattattggcaggttagagttaccaatcctagcaatattatgagaacttttgtcctatctccattttggttttactgcaattcatgattgattttactaaaagtaagcacacattcagattcaaaacggcctggtaccagattctccggatctagatgaaagatggaaaatttgtagactcaatattcaggaatgtgatgccgcacaaatgaaagttctgcatggtaatttatctactcattaataaacctttaactgattctatcaacccttggagcaaaggttaaatcttcggtctttcttggagcataagttatgttttgtcagctctatattttataaatcttctatgatttgcaggtttccgcagttccctgatcgatgcgataggagaatttcatgtgaacaaagagggtgggatgtttataaattcgtgcaattctcattgccagataagagagtcatggcattccgcaacctcaacaagaatcgaaaataaggttagaaaaagacaattgacgcaatctgttgctttcttttctctcgagcatctcttctagcaaattaatgaactttccaaactcatgtctcctctttttgtttttgttgaaacagacgattgcagagtctgtaggtgattggtacttcaaccgaaaaccggtgaagctaatcgattgtccttatccgtgcaatgcctcttgttgaacatggattttccgtatgttaatcattggaactgaaatagattgtatcgttttgatcttattacgatagcttttataacagtagaaatgtaatagtgcatgttattaacggtgcatgtttttcctttttatataaccgaaacgtgaattatataagtgtggatgtgacgaaccatatgaataaggtatctccctaaa

SEQ ID NO: 48 - DNA, 2045 bp, Arabidopsis
tcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaagatggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctaggtactactatttctcccacacaatcttaacttcttcttcttttttggtatttctatttgattcatcacttatcttctctgttttttactcttctccagattcgtttcgcagagaaatcgaaggtcttagctcttatgagccagttattacccctctgtgctcagaaatctccaatggttagtctttttatttcacctttttaccaactcctgaagaaaacagagttttgatcttttcatcttaatattagaaacagagttagtgtataatctgcataaaacttacggttatcgattcttgtttatgcacgcaggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttattaagttttttttggtaagttatttattttattaagttttgtagtatatcgtcgttattcgttaagataataatcaatttgttttc

SEQ ID NO: 49 - DNA, 1397 bp, Medicago
tggctaaaagaagcagaaatagtcatgcaaaaaatggagaatcttaaattacaatcaaaaccaccatcatggattgaatttaataaattgcaggaaaaaattacagcactaaataagaaatgtaattttgagccattttcaactacaattccaagtttagaacacttctctttaggaaataatttcgagtgtttcaagtcgacggagaaggcttcagatgaacttttggaggcactgcaagatgataattgttgtatgataggattgtacggtaggcgtgactctggtaaaactacgttggtgaaagtaatggaacagaaagtccaatatttgaatatttttgatgagattttatttgtcaatgtgaccaaaaacccaaatatcacagcaatgcaagatgaaattgctgactccttgaatataagatttgatagaaacagtgaagctggaagagcaagaagaatattatccacaatagaagatatggatcgtccaatacttgttatctttgatgatgttcgggcaaaatttgacctacgggatgtaggaattccttctaatagtaatcgatgcaaggtacttttgaccgcacgtcgccaaaaatattgtgacttagtttactgtcaaaggaagattctacttgatcccttatctacagaggaagcttcgacgttgtttgaaaaatattcaggcattctcgaagaggatcactcctcctcatttgacttattgaatgtggcacgtgaaattgcttttgaatgtgatgggttaccaggaaaaatcattaaggcagggtcttccgtaagaagtaaaccaatggaggaatgggaaaaatcactagacaatttgagacattcaactgctcaatgggagatgtttctcagttttagaggggaagatactcgctactcttttacaggtagtctttttcaagctttatcccaagggggattcaagactttcatggatgatgaaggactgcacactggggaccgagtttcaccttgtcttagaaatgcaattgaagcatcaagactttcgattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaatggttatggcaaagacatggctcaacatgaaaaaaaattcggaattgactcggagagagtacaaaaatggaagtcagcattgcttgaagtttctaatttgtccggaatgacttacacgactgggtatgaatatgaatttatccaaaagattgtagaagatgccaataatattaaaagtcgtttgcaaatacgaagcgtatagactataga

SEQ ID NO: 50 - DNA, 1148 bp, Arabidopsis
cgaaaacaaaccacataaactagtcaaagaagaatagatgagttacattataaaaaagttcaagtgagagaaagagaggtccaatggcggagaaagaagaggatgtgaagcttctaggtttttgggcaagcccttttactcgtagagttgagatggctttcaagctcaaaggcgtgccttacgagtacttggagcaagatatagtgaacaagagccctttgcttctccagataaatccggtttacaagaaggttccggttcttgtctacaaagggaaaatattatccgagtcacatgtgatcctcgaatacatcgaccaaatatggaagaacaatccaattcttcctcaagatccttacgagaaagccatggctttattctgggccaagttcgttgatgaacaggtaactttatcaactaattgcataggtgatttctaaaatatgactaacacctagaaccaccgatgactgtatgtaatttcattacattttgaatagtaaaatcaagattctgattctgatcgattggtaagctaggaaaggcagaattctaaaatgattctggttccataagaatgtctatgcaaaacaaaaattaattgcggttaattttctgctgaaatggttactatcttgtaggttggaccagtagcttttatgtctgtggcaaaagcagagaagggagtagaggttgcaatcaaggaggctcaagaactctttatgtttcttgagaaggaagtcactggaaaagatttcttcggtggcaaaacaattggatttttggacttggtcgcaggaagtatgatcccgttttgtcttgctcgaggttgggaaggtatgggaattgatatgattccagaggaaaagtttccagagctaaacagatggatcaaaaatttgaaagaaattgagatcgtgagagaatgtattcctcctagagaggaacaaattgagcatatgaagaaagttgtagaaagaatcaaatcagcctaagagacaacaatgatactcttcgatcagtagatgttaactatatgtttgtgtaatcttgttataatagtttgtatgaacaataaatgaaacatttgtatgaacaattagtgtttttactaaattctaatgtcaattaattattataaacatttt

SEQ ID NO: 51 - DNA, 692 bp, Arabidopsis
aaacccgtcaacacatcttctttaagcatctctctcccttcaaagaaaatatcacaaaaatggcaaacgtctccgctttgctcaccatagctcttctcctttgctccacgctaatgtgcactgcccgccccgaaccggccatctccatctctatcacgactgctgccgatccatgtaacatggttagtctgattcacatgccatgcatgaatcaatttccatatataaacacaaaataaccaatatcagagcttctaaatttttaaaaatatttaacacatcgaataggtttaataaattttttgtaatgtatgatgattactttggcaggagaagaagatagaaggaaaattagatgacatgcatatggtagacgaaaactgtggtgcagacgacgaagattgcttaatgaggaggactttggtcgctcatactgattacatctatacccagaagaagaagcatccttgattttcacttactcatttctaacaaacttttgctcaagattatgtaatttatgtcatccttaattagtatttgtcacatacaagatcaagatagttatgattgtgattatttatatgtattttggatgatatattgtagaactagaagtttgacaataaaaagtttatagtgtcgttgtatgtttaagaagtttgacaataaaaactttatagtgttgttgc

SEQ ID NO: 52 - DNA, 5069 bp, Medicago
ctagaatctaccattcgaccttccacttaatttcttttccaacaaagccaacattttctttaaaagcttgtattcactgccaataaacttgtataacacacagcttttgctacaagacatagaataactcagcacaatacgagctacaaagttgtagcaattgttgaacaaatggaagcctcttcttcttcttcttgcagatcaagttcaaccacaagtttatgcacctaccatgtctttttgagttttcgaggagaagatacacgcaaaggattcaccgatcatttatgtgctgcccttgaaagaaaagggatcacaacttttaaagatgacaaagaccttgagagagggcaagtcatttcagaaaagctaatcaatgcaataaaagattctatgtttgccatcactattctctcaccagactatgcttcttccacttggtgtttggatgagcttcaaatgatcatggagtgcagcagcaaaaacaacctgcatgttttgccagtcttctatggtgtggatccatctgatgtaaggcatcaaagaggatgctttgaggaagctttcagaaaacatcaagagaaattcggtcaacacagtgacagggttgatagatggagagatgctttcacacaagttgccagttactctggatgggactccaagggccagtaagttagctacctcttcaatagatatatttgtatgagtttaactgtgttaaaaattcaaaatcagactcatgtgcttgagtttaccttgtaattatctgaaggggtatgttaaacatacaaaatcatttccataatttcattttatttgcttatgatttggttgtttgttggcctcttctttccttctgtctcaacaggcatgaggcgtcactagtcgaaaacattgctcaacacatacatagaaagttggttcctaaattgccatcttgtacagagaaccttgttgggattgtttcaaaggtggaggaagtaaacaagttcttaggtatggggttgaatgacgttcgctttataggcatatggggtatgggtggcataggcaagtcaactattgctagagcggtctatgaaacaatccgatgtgaatttgaacttacttgctttctagaaaatgttagagagatatctgagacaaatggtttagttcacttacaaagacaacttctttctcatctgagtataagtaggaatgattttcatgatttgtatgatgggaaaaaaacaatacaaaactctttatgcagaaaaaaggttctacttgttcttgatgatgtgaatgaactaaaccagttggagaatttggttgggaaacaagattggtttggtccgggaagtagagtaataatcacaacaagagacaagcacttgctaatgacacatggagtacataaaacctataaaactggaatgttatgcaaacatgatgcccttgttctcttttgtttgaaagcctttaaaggagataaaccacaagaagggtatttggacttatccaaagaagtggtggactattgtggtggtcttccattggcacttgaggtgttaggttcctatctgtatggaagaaatattgatgtttggcatagtgctgttaaaaaattaagaagttttccccaccctagagtccaagataacctgaaaataagttatgatagtttagataccatggagaaggatatttttctagatattgcttgtttctttaagggaatgaagggagataaagttatagatatattagaaagttgtggctatttccctcaaattggaattcaaattttgattgaaagatcattgataactctagattctgtgaataataaattgggaatgcatgatttgcttcaagaaatgggcagggatattgtatttcaggaatctccaaatgatccttgtagacgtagcaggttgtggtctcaagaggacattgatcgcgtcttgacaaaaaacaaggtactagtaggagctaatatttctgcaactgtcggataattggttttatatgaaataactagcaagtatagattaactgatatgcactgttagtgtaaatatctcttacaatgtcaattaataacaaataatttgatgagattttaaggtagttaggacaaaagtaatcgtttataatcatcattgattaccattttgtttgcttaagtttgtgttttccttgattctataagatcatgtatttgttattatggttttgtagggaactgaagcaattaacagtattgatatgaaattacttcaaccatatgaagcacattggaacactgaagcattctcaaagacaagtcagctaaaatttctcagtttatgtgagatgcaacttcctcttggcctcagttgccttcctagttcattaaaagttcttcactggagagggtgtcctttaaaaactctccctataacaactcaacttgatgaacttgttgacattacattatctcatagcaaaattgaacaactctggcaaggagtaaaggtaatagactctttgaccaagaactctattaaagcttaccattatgacatttgatgctgataacttgttcacatttttacaactttgagcagtttatggaaaagatgaagtacttgaatttggctttttccaagaacctaaagagattgcctgatttttctggtgttccaaatcttgaaaaattgattcttgaaggctgtgaaggcctaattgaggttcatccatcccttgcacaccacaagaaagttgttctggtgaatttgaaagactgcaaaagtcttaaatctctttcagggaagttggagatgagttccctgaagaagttaattctttcaggcagcagtaaatttaaattccttccagagtttggggaaaaaatggaaaatttatcaatgcttgctttagaaggaacagatataagaaaactgcccttatcacttggaagactagtcggacttactaatttgaacttaaaggactgcaaaagcctggtttgtcttccagataccattcatggattgaattccctcataactctggacatttcaggatgctcaaaactttgtagactgccagatggtttaaaggaaatcaagtgtttggaggaactccatgccaatgatactgctattgatgaactaccttcctccattttttatctagatagtcttaaagttttatcatttgctggttgccaagggccatcgacaacgtcaatgaactggtttcttcccttcaatttgatgtttgggagtcaaccagcttccaatggattcagattaccaagttctgtcatgggattaccttctttggaatatttaaacctaagttattgtaatctttctgaagaatcattcccgaattattttcaccacctatcatctttgaagtctttggatctgactggtaacaattttgttatcataccaagtagcatttctaaactttcaaggcttagatttctttgtctaaattggtgccaaaagcttcaattgttgccagagcttccattaaccatgacacagttgaatgcaagcaattgtgattcactggacactatgaaatttaatccagcaaagctatgcagtctctttgcatcacctagaaaactgtcctacgttcaagaactttacaagagatttgaggtatgtatctcctcattatctgtaactgtgtaaaaattcttgaagtactttgatggtgatacattaagccattcaatgcataataaataggacacaaatagaatatgatatctaagattaagggcctattccgattgacttattcgtgcttctttaccggcataagcagttgtgagactgtttcggagaacttatggaattatttgtgcttctctaccgacataacacttgtgagactgtttcggagaacttatggaaacagcttatgacatgtccataacctctccatgatagcatatgaaaacaacttttaagttgtatgaaaagttcttgactttatttcatcttttgtcataaaaatagcttatacataagcatttatatgataaacgcttaattaaactgtttagtcaaacaaggcttaactttgtaataataatgtgtattatgcattactctcatagtatataagcatttcgtgtgttagtttacttgaggatggctatgacataatctctcatagttgtatgaaaagtttcacaattatgtgtagcacaatgatacaaatagaatatgagctgtaagattaactttgtagtaaaagtttcacaattatgtgttgcaggatcgttgtctccccacaacaagatttgacatgcttatcccaggggatgaaattccatcttggtttgttcctcaaagatccgtttcctgggcaaaagtacatatccctaataatttccctcaagatgaatgggtaggatttgcattgtgtttcctattagtgagttatgctgacccacctgaattgtgtaagcatgagattgattgttatttgtttgcatctaatggtaagaagttaatcaccaccaggagtttacctcctatggacccatgttatcctcatctttatattctctacatgtccatcgatgaatttcgcgatgaaattctcaaagatgattactggagtgagagtggcattgaatttgtattgaaatgttactgctgtcaatcattgcaagtagtgagttgtggttcccgtttggtttgtaagcaagatgttgaagattggagcaaaatgagtcatttcaacgagagttgaagatatttgcagatcatatagttggtacttgtcaataacatcattccttgagatgcaagtaacatgatattacaaattggaccatcaagatgctgcacatgcatcttgaaacagtatcagatgcagaagaaatcttaaatattagaaagtttgaaacctgttttagtggtctttgtttaaagaagatggtaaagagtccaagataatcagcaacttgatgtggtttaaatttgaacttgatttatatgataacgattaattagttctgactgactcatgtaatatttcatctatatttaggtaaaattgaaacg

SEQ ID NO: 53 - DNA, 1662 bp, Arabidopsis
aattacacattttatccagaaataaaaataatcaataaatacgcatgaaggtcattgtaatgcatatcaataactcgttccctctctcctcaggtaaattctcagtctctcgtctgataatagttttgtagagtttggttaataaaactaatcgtgtacgctactaatacgtacaggtaactaattaatattcaaaaagatggctcaaaaagtggaagcagggggtggcgccggaggagcttcatgggatgatggtgtccacgatggcgttagaaaggtgcatgtagggcaaggccaagatggtgtgtcatctatcaacgtcgtgtatgcgaaggactctcaggatgttgaaggaggtgaacacggaaagaaaacgttacttggatttgaaacggtatgtagtggtgtttgctaccactctctttgagtttaacttattagccttgttcggatcagttttaaagctttgtaaaatgagaaccaattaagactagaccaattcacacctaatacggtctagattgagttaatctatacaacatctctactcacgagaggtatcttttcgatcattgcagtttgaggttgatgcagacgactacatagtagcagtgcaagtgacctacgacaacgtgtttggccaagactctgacatcatcacatctattaccttcaatacattcaagggaaaaacatctccaccctatggattggaaacgcaaaagaagtttgtactcaaggacaaaaacggtggtaaacttgttggcttccatggacgcgctggtgaagctttatatgctcttggagcatattttgctacaaccacaactcctgtgactcctgccaaaaaactatctgcaattggtggtgatgaaggaactgcatgggacgacggtgcgtacgatggtgtcaagaaggtgtacgtaggacaaggccaagatgggatatcagccgttaagtttgagtacaacaaaggcgcggagaatatcgtaggaggtgaacatggaaagcctactttactcggattcgaggaggtattttttgtttttgctatcaaaattcaaaatatgttgtatcttttcattttcttaaaactaattgacagtaagcagattgatctatatgatttaaaatcctttaattgcagtttgagattgactatccaagtgaatacatcaccgcagttgaaggcacctatgataaaatctttgggagtgatggcctaatcataactatgcttaggttcaagactaataaacaaacgtctgctccctttggacttgaagctggcacagccttcgaacttaaagaggaagggcacaagatcgttggcttccatggaaaagccagtgagttgcttcatcagtttggagtccatgtcatgccactcaccaactgatcacattacagctacctccttcgcttccatcgaacttgttaatgtgatctcttgaaaataacttgttatacctatgatggttatgcctatctatgtttaaatgtttttaagcgttctcttttgtgatgttggtctttatataatgttacgtatgatagatttgaataaaggtggttgattccatccctataaattgcacattaagtcccatcgtgaacaacgttcgatccatactaaattaagttactgcaagtgtgtttagc

SEQ ID NO: 54 - DNA, 3221 bp, Arabidopsis
aaaatgggtcccacttttcccatttcccaacctccataaccaaagttggagatttctctgtttcctatgctctctctctctcttactctcacagtgactattcgtcgcttcagatctaaaagagaggaagataaaccatttggattcaatatcgattaaggtaagaaagccatcttctacttgttggattcgattagtttcatttcagctcattgcctctttacttcttcaatgttgatttcttgctttggctttggttttatcaccaatgctgtttgatttctttgaagttcctttcgagcttttcttgagcttagtttcacattcttagcttcactaagttctttgatgtgtttttgttcccaagttcaaaatgttgtttctgattcaatttggttttctaaaaaagattgcaactttggtttcttttagtgtatagttagtttggatcttcactaaatatgttcgttgtttctacttttgtaggaaaccttttgacttcacaagaatggcagtgacagaagcagaaaatcctcttcttggtgaaatcacttgtggcaccttactacagaagttgcaggtagatttcgcaacatacacacttatccttttaatatatggttccacaaactcaatgtacaaacttgttacaggaaatctgggatgaggttggggagagtgatgaagaacgagacaaactgcttctacagattgaggaagagtgtctgaatgtttacaaaaagaaagttgagctagccgcaaaatctcgtgcagagcttcttcagactttgtcagatgccactgttgaactttccaatctcacaactgctctcggggaaaaaagctatatcgacattgtaagtaatctcacgtcttacaagtggtaaagagatgagatggttacagtgtagtgtgattcaatgtctttgtttccattgcagcctgataagacttcaggaacgatcaaagaacaactttctgcaatagcacctgcgcttgaacaactttggcaacagaaagaggaaagggtccgggcattttctgatgtacaatcacagattcagaagatatgtgaggagatcgctggcggattgaacaatggacctcatgtggttgatgagactgacttgtctctaaagagattagatgacttccagaggaaactccaagagctccagaaagagaaggtaaaatattagttgggatatggttatgtgtggcctatgttcaaaccagaactaaaactgctttgtgtttgagcagagtgataggttacagaaggtgctcgagtttgtgagcacggtgcatgatctatgtgccgtccttcgtttagatttcttaagcactgtcaccgaagttcatccgagcttagatgaggcaaatggtgttcaaaccaagagcattagcaatgaaacacttgcaaggttggctaagactgtcttgactcttaaagaagataaaatgcaaagacttaagaaggttagtcaaaatcatggtctttgtgatctctgacatgagcttggtcagtttaggctgcacatatgttgaaatcctttctgattaattgcgctgaaagtttgtaacttttctctgcaccattcttgtttgtggatttcattaatgtatcttggttttatgcagcttcaagaactagctactcagctaactgatctatggaatctgatggatacttctgatgaggaaagggagctttttgaccatgttacctctaacatttcagcttcagttcatgaagtgactgcctctggtgctctcgcacttgatcttatcgaacaggtatcgtaaatttgtaatgtatcaatcaatgtgtatgataagtactgcttttaaaaatcttctgtgaactcttgaaggctgaggtggaagtggataggcttgatcaactgaaatctagcagaatgaaggaaattgcattcaaaaagcaatcagagcttgaggagatatatgctcgtgctcacatagaaataaaaccagaggttgttcgtgagaggatcatgtcgttgattgatgctgggaatactgaacctactgagttactggctgacatggatagccagatcgcaaaggccaaggaggaagcctttagtagaaaagaaattttagaccgtgtagagaaatggatgtcagcttgtgaggaagagagctggctcgaagattacaatcgagtatgctaacattggctatgttaataaacacattacttattaagcatagagttcaattgatgattcttttgggtttttgttctggaaaaacaggatcagaacaggtatagtgcaagccgaggtgcgcatttgaatctcaagagagctgagaaagctcggattctggtcagcaagattactggtaagaacttccaaaagtctctcttagttattactacacatagaattaaactgagactgaagaatatatcatactttgtttgtgcaagctatggttgacacgttgattgctaaaacccgggcatgggaagaggagaacagtatgtcctttgagtacgatggagttcctttactcgccatgctagatgaatacactatgcttaggcaagaacgagaagatgagaagcggaggctgaaagtaagttgtttcatcctgtgttaaaccgattgttgaaactaacttcttttaaaataatcttgccttttcattaacaggaacagaagaagcagcaagaacagccacacacagatcaagaatccgcctttgggtctaaaccaagccctgcaagacccgttagtgccaagaaaccggtgggaacacgagtcaatggaggagggctcaacgaaactcctatgaggcgtttgtctatgaactcaaaccagaacggaagcaagtccaagagagacagtctgaacaagatagcttcaccttcgaacattgtagccaacacaaaagatgatgctgcatctccagtctctcgtgctgacccagtgatggcttcaccgtgacaatatcaaaagaaagagagttataatgcttacttacacttttgttagttgctaatagtgctgtttaagaaacaaacacttagaaacaaagacaatgagagtagaatgttacttagatgtttctgtttctgtattcattcactcaaatttgtttggtacttgttagcatgactaatgtgaagtgaccggtttagtgaatgaaagtcaaggttctaattggaattacgaaataatatttgggcaaaa

SEQ ID NO: 55 - DNA, 1787 bp, Arabidopsis
ttgatatcatcactcgaataattcactttataactatctccgtcactatcaaaaagtgttcaaaattaaaaaagaatatctcaatccttatccacttcatcattcctagcttccaagttattattatataactcaatttttctggcttaagagttttgaaaaatatcttcactagagatgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcaggtacaacaatttcattcacttcctatacatagacgaacactgattcagataagagtatcaacgaatcatgtttgattttgatttcagattactgttcgacgcttgaaggtgatgactcttacagttgctggagagcttactttgaactcaaagatctcgaagtaagtaattctatagttttttttttcaatttgagaatccaaagaatttagtgatagtgactagatttggttatgtgattgcagagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactgaaagcggattacggattacggtacctttagaaagttgttatcttatcacagttatatgtaaatatagttcttggttttgctttagttcatgtagtctatcttttgttaagatgtgatcatattgccatagaaatgtggttgttattacttgatgttcgccaatgttgaatttgtttaatgctgtgtgcctattatagtactacgcggttttggtttacgaagagatttctattcttgataactgaagtggattactacggtacgacctatagaaagttgttttcttatcacatttatatgtaattatagttcttggttttgctttagattatataatgtctctttgttaagatgtgatcatattgccagagaaatgtggttttattgcttgatgttcgccaatgttgagtttgtttttaatgtcgtgtgcctattatagtactacgcggttttggtttacgaagagatttctgttcttgataacggaagtggattactacggtactacctttagaaagttgtttcttatcacatttatatgtaattatagttcttggttgtgctttagatcatatattgtctctttgctaatatgtgatacatattgccatagaaatgtggttgttattgcttgatgttcgcgaatgttgagtttgtttttattgtcgtgtgcctattatagtactacgtggttatttggtttacgaagagatttctattcttgatgatgtttgttctccggatgtgaagctaaatctttgaaaggaaaacaagagttttctaaatatagggaaaagatttgtttggtgatgcaaagatgaaaattgt

SEQ ID NO: 56 - DNA, 1204 bp, Arabidopsis lyrata
atcatcatcacaaagtcttctcatttcctcatcttcttgttgaaagtaatggcaagactcaagagctttctccttcttctttctctcctttgctttgtccctctctgtctctgtgacacgagcaatggaggcaaactctgctctggcttttacgcccgttcatgcccgcaggccgaggagatcgtaagatcagttgtagctaaagctgttgttagagagacccgtatggctgcttccttattgagacttcatttccacgactgtttcgttcagggttgtgatggctctttgcttctagacagcagtggaaggatagtgagtgagaaaaactcaaaccctaacagcagatcggctcgtgggttcgacgtagttgaccagatcaaagctgaattggagaaacaatgccccggaactgtttcttgcgctgatgttcttaccctagccgctagagactcctctgttgttaccggtggaccaagctgggtggttccattgggaagaagagattcgagaagtgcaagcttgagcggttcgaacaacaacatccctgcaccaaacaacactttccaaaccattctatcgaagtttaaccgtcaaggacttgatgtcactgaccttgttgctctttccggtagtcacaccatcggattctcgagatgcacgagtttcagacagaggttgtacaaccagtccggaaacggccgtccagacatgacattggaacagtcatttgctgctaacttgcgccaaaggtgtccgagatccggtggggaccagattctctcggttttggacatcatcagcgccgcaaaattcgacaacagctatttcaaaaacttgttagagaatatggggctattgaattcggaccaagttttgttcagcagtaacgagaaatcgagagagctagtgaaaaagtatgcagaagatcaaggagagttttttgagcaatttgcggaatcgatgatcaagatgggaaatatctctcccttgacaggttcgagtggcgaaatcaggaagaattgcaggaagataaactcttgaattcttgaaacaagaaaacaataaatatatcttgaggaagaaatgtgagacatttgcttttacagttttacttgtttttttttttgttcattctgtcatttgaagttttatgttgggttatttgctttgtgttaagacataagcttgaaatttataaaac

SEQ ID NO: 57 - DNA, 1100 bp, Brassica rapa
atcacttctcatcacaaagtcttctctcctttcttcatcttctcgtcaaacataatggcaagactcagcagctttctctttgttctttctctcctttgcgttctccctatttacctctgccaacagagctatggaggcaaactaaaccctggttactacgcacattcatgcccgcaagccggagagatcgtgagatcagttgtagctcaagctgttgctagagagacacgtatggctgcttccttgatgagacttcatttccacgactgcttcgttcagggttgtgatggctccttgcttctagacagcagtgggaggatagtgagtgagaaaagctccaaccctaacagcaaatcagctcgtggatttgaagtagttgaccagatcaaagctcaacttgagaaacaatgccctggaactgtctcttgtgctgatattctaaccctagccgctagagactcctctgttcttactggtggaccaagctggatggtcccattgggaagaagagattcaagaagtgcaagcttgagcggttcgaacaacaacatccctgcaccaaacaacactttccagacaatcctcagcaagtttaatcgtcaaggacttgatgtcaccgaccttgtcgctctctctgggagtcacactattggattctcgagatgcacaagtttcagacagagactatacaatcagtccggaaacggtcgtccagacatgacattggaacaatcattcgctgctaacttgcgacaaaggtgtccaagatctggaggggaccagaatctctcggtgttggacatcgtcagtgcggcgaaattcgacaacagctatttcaagaacttgatagagaacatgggtttgttgaactcggaccaggttctgttcagcagtaatgataaatcgagagatcttgtaaagaagtatgcagaggatcaagaagagtttttcgagcagtttgccgagtcgatgatcaagatgggaaatatctctcccttgaccggttcgagtggtgaaatcagaaaggattgcaggaagataaactcttgaattcatgatatgagtaaaatgtttttgaggggaagaaaatgtgtgacact

SEQ ID NO: 58 - DNA, 1278 bp, Raphanus sativus
ggrtatccctcctcatcacaaagcctttctccttccttcatcttcttgttaaaagtaatggcaagattcactagctttctcctygttctttctcttctttgcttcctccctctttgtctctgtcacaagacctctggaggcaaactctccccatattactatgcacattcatgcccacaagccggggagatcgtgagatcagttgtagctaaagctgttgctagagagacccgcatggctgcttccttgatgagacttcatttccacgactgtttcgttaagggttgtgatggctctttgcttctagacagcagtgggaggatagtgagtgagaaaaactcaaaccctaacagaaaatcagctcgtggatttgacgtggttgaccagatcaaagctcagcttgagaaagaatgtcctggaactgtctcttgcgctgatgctctcaccctagccgctagagactcctctgttctcactggtggaccaagctggatggtyccaytgggaagaagagattcgagaagygcaagcttgagtggttcgaacaacaacatccctgcrccaaacaayactttccagacaatyctcagmaagttyaawcgtcaaggacttgatatcaccgaccttgtcgctctctccgggagtcacaccataggattctcgagatgcacgagtttcagacaaaggctatacaatcaatctggaaacggtcgtccggacatgacactggaacaatccttcgctgctaacttgcgccaaaggtgtccaagatcaggaggagaccagaatctctcggtgctggacaaggtcagcccggcgaatttcgacaacagctacttcaagaacttggtagagaacatgggtttgctgagctcggaccaggttctgttcagcagtaacgataaatcgagagagcttgtaaagaagtacgcagaggatcaaggagagtttttcaagcagtttgcggagtcaatgatcaagatgggaaacatctctcccttgacgggttcgagtggagaaatcaggaagaattgcaggaagataaactcttgaatgcgtgcgtgatatgaggaaactgaaatgaataaaaaaaaaatattttgtggggaaagaaatattatgaatgacagtttgctttattttgtttgtgatatgttgtatttttaattttccatttgaagttttatgttgtgttatttctgattttgctaagagagtagtgaaatatattcctattattttatcgctgatttacatccttcattcaacaaatgataa

SEQ ID NO: 59 - DNA, 1250 bp, Arabidopsis
catatctcctaccatcacaaagtcatctccttcttctttcttgatctagctagcggaaaatttgacaatggcaagaatcggaagctttctcattattctttacctcatttacgctcttactctctgcatctgcgacgacgacgagagtaactatggcggcgacaaagggaacctcttcccaggtttctacagaagctcgtgccctagagccgaggagatcgtgaggtcagttgtagccaaagctgttgcaagggagactcgtatggctgcttctctcatgaggctccatttccacgattgtttcgttcagggttgtgatggatcgttgcttctagacaccagtgggagtatagttactgagaagaactctaacccgaacagcagatcggctcgcgggtttgaagttgttgacgagatcaaggcagcattagagaacgaatgccctaacactgtttcttgtgctgatgccttaactctagccgctagagactcctctgttcttactggtggaccaagctggatggttcctttgggaagaagagattcgacaagtgcaagcttgagtggatcaaacaacaacattcctgcacccaacaacactttcaacacaattgtcacgagatttaacaaccaaggtctcgatctcaccgacgttgttgctctctccgggagccacaccattggattttcaagatgcactagtttcagacagagactgtacaaccaatccggaaacggaagtcccgacagaaccttagagcaatcctacgctgctaacttgcgccaaaggtgccctagatcgggtggggaccagaacctgtcagagcttgacatcaacagcgctggaagatttgataacagctacttcaagaacttgatcgagaacatgggactgttgaattccgacgaggtcttgttctctagcaatgagcaatcaagagagctcgtcaagaagtatgcagaggatcaagaagagttcttcgagcagttcgcggagtcgatgatcaagatggggaatatctctcccttgacaggttcgagtggtgagatcagaaagaattgcaggaaaattaataactcttgatttcctagtatcggatgggagaaatagaaatgtgacatgttttggaggaaggaatttatgtttatgtttttttttatattgtatgagtctgtatttctttgtgtcaagaatttgaattttgtaagtttaaatgattgaaactatctataattaaaatgttattaca

SEQ ID NO: 60 - DNA, 1253 bp, Arabidopsis lyrata
catatctcttaccatcacaaagtcatctccattcttctttcttgatctagctagcggaaattggcaatggcaagaataggaagctttctcattattctttatctcacttacgctcttactctctgcatctgcgatgacgacgagagtatgtactatggcggcaacaaagggaacctcttcccaggtttctacagaagctcgtgtcctagagccgaggagattgtgaggtcagttgtagccaaagctgttgcaagggagactcgtatggctgcttctctcatgaggctccatttccacgattgtttcgttcagggttgtgatggatcgttgcttctagacaccagtgggagtatagttactgagaagaactctaaccctaacagtaggtcggctcgcgggtttgaagttgttgacgagatcaaggctgcattggagaatgaatgccctaacactgtttcttgtgctgacgccttaactctagccgctagagactcttctattcttactggtggaccaagctggatggttcctttgggaagaagagattcgagaagtgcaagcttgagcggatcaaacaacaacattcctgcacccaacaacactttcaacacaattgtctcgagatttaacaatcaaggtctcgatctcaccgacgttgttgctctctccgggagccacaccattggattttcaagatgcactagtttcagacagagactttacaaccaattcggaaatggaagtccggactcaaccttagagcaatcctacgctgctaacttacgccagaggtgccctagatcgggtggggatcagaacctgtcggagcttgacatcaacagcgccggaagatttgataacagctatttcaagaacttgatcgagaagatgggactgttgaattccgacgaggtcttgttctctagcaatgagcaatcgagagagctggtgaagaagtatgcagaggatcaagaagagttcttcgagcagtttgcggagtcgatgatcaagatggggaatatctctcccttgacaggttcgagtggtgagatcagaaagaattgcaggaaaattaataactcttgattccctagtattggatgggccaaatagaaatgtgacatgtttttgaggaaggaatttatgtttgtgtttttttttttttttgataaaaatgagtctgtaattccttgtgtcaagaatttgaattttgtaagtttaaatgattgaaactctctataattaaaatgtta

SEQ ID NO: 61 - DNA, 2873 bp, Arabidopsis lyrata
cttccttttttctccaacggcggcttatggctgttttccggcactaatcagctccggcatatatataaacaaacgtacttacacgttttttttttatatgaatccaaactagtttcagatttgtcgctatctcttcacttttgagtcttctggttttgtcaccaccagcttttttgttctctctctctctctctcttttttttgtttactctcttcgtcgttgagtttctatgagagaaagatcggaatgtcgaagagaattagaagattctcgtacgtcgcttcgttggaatttcacatgtcgatgagatctaagaactgtttcactttgatccaaaatcatctctttcagagtataatggactaagcattggtttaatgtgaaaatggttaaagaaatatcttatgggttcttgatactatcaatggtgatgtttgtttctccggtgatagctataaacggcggtggttatccacggtgtaactgtgaatacgaaggaactagtttctggactacagagaatattcttgaaactcaaagagtaagcgatttcttaatcgcagtagcttacttctcaatccctattgagttactttactttgtgagttgttccaatgttccattcaaatgggttctctttgagtttatcgccttcattgttctttgtggtatgactcatcttcttcatggttggacttactctgctcatccatttagattgatgatggcgttgactgttttcaagatgttgactgctttagtctcttgtgctactgcgattacgcttattactttgattcctctgcttttgaaagttaaagttagagaatttatgcttaagaagaaggctcatgagcttggtcgtgaagttggtttgattttgattaagaaagagactggctttcatgttcgtatgcttactcaagagattcgtaagtctttggatcgtcatacgattctttatactactttggttgagctttccaagactttggggttgcagaattgcgcggtttggatgccgaatgatggggaaacggagatgaatttgactcatgagttgagagggagagttggttatggcggttgttctgtttctatggaggatttggatgttgtgaggattagggagagtgatgaagtgaatgtattgagtgtggagtcgtctattgctcgggctagcggtggggatgttagtgagattggtcccgtggctgccattagaatgccgatgcttcgtgtttcggattttaatggagagccgagttatgcgattcttgtttgtgttttaccgagcgggcagcctcgggattggacttatcaggaaattgagattgttaaggttgtggcagatcaagtaacggttgcgttagatcatgcagcggttttggaggagtctcagcttatgagggagaagctggcggaacggaacagggcgttgcagatggcgaagagggacgcgttgagggcgagtcaagcgaggaatgcgtttcagaaaacgatgagtgaagggatgaggcgtccaatgcattcaatactcggtcttttgtcgatgattcaggacgagaagttgagtgatgagcagaagatgattgttgatacaatggtgaaaacggggaatgttatgtcgaatttggtgggggactcaatggatatgtctgacggtagatttgtaacagagatgaaaccgtttagtctgcatcgtacggtccatgaagcagcttgtatagcgaggtgtttgtgtctatgcaatggaattaggttcttggttgacgcggagaagtctctaccggataatgtagtaggcgacgaaagaagggtctttcaagtgatacttcatatggttggtagtttagtaaagcctagaaaacgtcaagaaggatcttcattgatgttaaagattttaaaagaaagaggaagcttggataggagtgatcaaagatgggcagcgtggcgatcaccggcttcttcagcagatggagatgtgtatataagattcgaaatgaatgtagagaatgatgattcaagttctcaatcatttgcttctgtttcgtcaagagatcaagaagttggtgatgtgagattctctggcggctatgggttaggacaagatctaagctttggagtttgtaagaaagtggtccagttgattcatgggaatatctcggtggtccctggctcggatggttcacctgagaccatgtcgttgctccttcggtttcgacgtagaccctctatatctgtccatggatccagcgagtcgccagcacctgaccaccacgctcacccacattcgaattctctattacgtggcttacaagttttattagtagacaccaatgattcaaaccgagcagttacacgtaaactcttacaaaaacttggatgcgatgtaaccacggtatcatctggattcgattgcctttccgccgttgctcccggctcgtcctcgtcttctacttcgttccaagtggtggtgcttgatcttcaaatggtagagatggacggttatgaagtggcaatgaggatcaggagtcgatcttggccgttgattgtggcgacaacggtgagtttggatgaagaaatgtgggacaagtgtgcgcagattggaatcaatggagttgtgagaaagccagtggtgttgagagctatggagagtgagctccgaagagtattattgcaagctgaccaacttctttaagttgctatctcaccttctcttctacattcaaaatttttacaacattatttatgtcaaatatatcaaaacgaaatttcgaaattgttattatataccacccatatctctatgatttgtacatgttgctattttttgttctttttctcatttggaccccacgaaattgcattg

SEQ ID NO: 62 - DNA, 2330 bp, Brassica oleracea
atgatggtgagagaagtagcttctgggttattgatactattctcgatactgatctgggtttctccggcggcggctggaaacggcggcgggtgtaactgcgaagacgaaggagtaagcttctggagcacagagaacatccttgagacgcaacgagtaagtgacttcttgatcgcagtcgcttacttctcaatcccgatcgagttactctacttcgtgagctgctccaacgttccattcaaatgggtcctcttcgagttcatcgccttcattgtcctctgcggtatgactcatctcctccacggttggacttacggtccccaccctttcaagctcatggtggcgttgaccgttttcaagatgttgaccgctctcgtctcctgcgccactgcgatcaccctcatcactctaatccctctccttctgaaagttaaagttcgagagtttatgctcaagaagaaggctcatgagcttggacgtgaagttggtctcattatgattcagaaagagaccggcgttcacgtccgtatgcttactcaagagatacgcaagtccttggaccgtcacacgattctttacactactttggttgagctttcgaagaccttggcgctgcagaactgcgcggtgtggatggagaatgaaggtaagagtgagatgaatctgactcatgagcttagaggaagctcggggaggagtggttatggctactctgtttctatgcatgatgtggacgttgttagggttagagaaagcaatgatgtgaatatactaagcgttgactcgttgatagctcgagctagcggcggagatgttagtgagattggaccggtggctgccattagaatgccgatgcttcgcgtgtcggattttaaaggagggacgcctgagttgattcagacatgttacgccatactcgtctgcgtgttacctagcggacagcctcgggactggagttatcaggagattgagattgttaaggtcgtggctgatcaagtagccgttgcgttgtctcacgcagcggttcttgaggagtctcagatgatgagggacaagctcgcggaccagaacagggccttgcagatcgcgaagagggacgcgatgagggcgagccaggcgaggaatgtgttgcaaaaagcgatgagcgaagggatgagacgtccgatgcattctatacttggtcttttgtcgatgatacaggacgagaagttgagtaatgagcagaagatgattgttgatacgatggtgaagaccgggaatgttatgtcgaatttggtcggggacgcgatggatgtttctgacggtagatttgtcacggagatgaagccgtttagtctgcatcgtacggtccgtgaagcggcttgcttggcgaggtgtttgtgtctttacaatgggtttcggtttacggttgatgcggaaatgtctctgcctgataatgtagtgggagatgaaagaagagtgtttcaggtgatacttcatatggttggtagtttagtaaagcctagaaagtgtagagaaggatccttgtcgtcgtcggtgatctttaaggtttttaaagaaagaggaagcttggataggagtgatcaaagatgggctgcatggagatcacctacttgttcggcggatggagatgtgtacataagattcgaaatgagtgttgagaatgatggttcaggctctcaatcatttgcttctgtttcgtcaagagatcaagaagttggcgaagtgagattatctggctatgggttaggacaagatctaagctttgatgtttgtaagaaagtggtgcagttaattcaagggaacatctcggtggtccctggctcggacggctcgccggaaaccatgtcactgctcctcaggtttcgacgccggccgtccatatcagtccatggaacaggggaagcaccggctccagaccaccaccttcaccctcattctgattctctgttacgtggcttgcaagttttattagtagacaccaacgattcaaaccgggcggttacgcgtaaacttttagaaaaacttggctgcattgtaaccgcggtatcatctggattcgattgcctcactgccattgcacctagctcttcctcatcttcctcaacgttccaagtggtggtgcttgatctacaaatggcagagatggatggctatgaagtggccatgaggatcaggagccgatcttggccgttgatggtggcaatgaccgtgagcttggacgaagaaatgtgggacaagtgtatgcagattgggatcaatggagttgtaagaaagccggtgatgttaagagctatggagagtgagctccggagagtattgttgcaagctga

SEQ ID NO: 63 - DNA, 802 bp, Arabidopsis lyrata
acttacgaagtagcacaaccatggcgatttctcagcaatttctaaaccctacactcttcaaatccttagcttccacaaacaaaaactcgccatctcctttctttcgactcaagtccacctccacaactttcaatttcaaaccacttacttcctcctcctctgctacaatcatcacacgcgccgccgtatcatcctccgattcaggcgagtcaaaatccagagaaactttccacggcctctgctttgtcttgaaagacaacatcgacaccgatcaaatcatccccgccgagtacggcactctcatcccttcgattccagaagatcgcgaaaagcttggctcgttcgcgcttaacggcttaccaaaattctacaatgaacgtttcgttgttccaggagagattaaatcaaagtactccgtcatcatcggcggcgataatttcggttgcggatcttcccgcgaacacgctccggtttgcctcggcgcggcgggagctaaagccgtggtggcggaatcgtacgctaggatcttcttcaggaactgtgtagctacaggtgagatcttcccgctcgaatcggaggttaggatctgcgacgagtgcaaaacaggggatgtggtgaccatcgaacacaaggaagacggtagtagtttgctgatcaatcatacgacgaggaaagaatacaaacttaaaccgctaggtgatgccggtccggtgatcgacgccggtggaatcttcgcttatgcaagaaaagccggcatgattccttctgcttcctctgcttgagtataatataatcgaatcca

SEQ ID NO: 64 - DNA, 1892 bp, Arabidopsis lyrata
agttctgagcagtgaaactaatggcaataaaagagcgatcgttggaggagacaccaacatgggctgttgctgttgtttgcttcgttctccttttcatttccatcatgatcgaatacttcttgcactttgttggtcactggtttaaaaagaagcacaagaaagctttatctgaagctcttgaaaaggttaaagcaggcaattgatgcttctgggattcatatcgcttctattggttgtattgcaaacaccagtctcccagatttgcattccaagaaatattgctgcgacttggcatccttgtagcaaccatcaagaaattgctaaatacggtaaagattatatcgacgatggccgcaaaattcttgaagattttgactccaaagacttttatagtcctcgccgaaatttagccaccaagggttatgacaaatgtgcagaaaaggcaattctcatatttacttactgattatagggaaagtagcattagtatctgcttatggtatccaccagctgcatatattcatctttgtgctcgctgtttttcatgttctctactgcattataacctatgctttaggaaagaccaagatgaagaaatggaagtcatgggagagagagaccaaaacaattgagtaccaatatgccaatgatccagagaggttcagatttgcaagagatacatcgttcggacgtagacatttgaatatatggagcaagtctacatttaccctctggattacatgtttcttcagacagttctttggatcagtgacaaaagtagattatcttacactaagacatggctttattatggcacatttgccagcaggaagtgcagctcgtttcgattttcaaaaatacattgaaagatctttggaacaagatttcacggtggttgtcggtataagcccactgatatggtgcattgctgtcttattcatactgaccaatacacatggatgggactcatatctttggctgcccttcattcccttgattgtaatattgatagtaggagcaaaacttcaaatgataatatcgaaattgggattaagaattcaagaaaaaggagatgtggttaaaggagctcctgttgttgaaccgggtgatgatctcttttggtttggtcgtcctcgtttcattctcttcctcattcacttggttcttttcacgaatgcatttcaactggctttcttcgtttggagcacttacgaattcacactcaaaaactgcttccaccacaaaacagaagatattgcaattaggatcaccatgggggtattaatacaagttctatgcagctacatcactctacctctatatgctcttgttactcagatgggaacatcaatgaggccgaccatattcaacgacagggtagccaatgcattgaagaaatggcaccacacagccaagaaacagacgaaacatggacactcgggatctaacacacctcactcgagccgccctactacgccaacacatggcatgtcaccggtgcatctcctccacaactacaataaccgcagcctcgaccaacaaaccagcttcactgcctctccttctcctcctagattctctgattatagcggccaaggccatggccatcagcatttcttcgaccctgaatctcagaatcactcttaccagcgtgagatcacagattctgaattcagcaatagtcatcatcctcaagttgacatggcaagtcctgttagagaagagaaggagattattgagcatgtcaaggttgatttgtctgagtttacgttcaagaagtgataggacttttctactttttacatgctgtttgttcattctttgtaaatgatatgaacttaggaatgaacacttttcttgtttctttatatgaattttgctataagctcaaa

SEQ ID NO: 65 - DNA, 1400 bp, Arabidopsis lyrata
tcttcttcaatggcgattccaaggtttagctctctgttacggtgtagaaaatgggctaagagtgactggcttgtcgcttctatcggattcgtattgattgtttttttcctctctttcttcatcgatcccacttcagactctgtcccctccgttgaccgatctcggccaatcatattccctagcgatctggtcaaactgaagttgtcgagtatagctaaagagagaggagctttttgtttggatggaagcttgcctgggtaccattttcatgagggttctggatctggctcccaaagctggcttgttcatttggagggtggaggctggtgcaacacagttgcgtcatgttctgctcgagcattgactaaattaggttcttccaactactttgaacaagaagtggcctttcaaggtgttttaagcagtgacccatctcaaaatcctgaattctttaactggaacaaggttgcgataaggtactgtgatggtgcttcttttgctggacaccctgaagctgaattcaagaatgaaacccggcttttcttccggggtcagctcatttgggaagctattattgatgaactgttgtcgatgggcatgtcagatgcgaaacaggccatacttacaggatgttctgctggtggcttggcaagtcttatacattgtgactactttcgagatcatcttccaaaagatgcagctgtcaaatgtgtttctgatggaggctactttctcaacgtgccagatgtccttggaaacccaacaatgaggtctttctatcatgatgttgctaatttgcagggtgtagataagagcttggatcagaaatgtgaagccaaaacaaagccatctaagtgtatgtttcctcaagaattcctgaaaaacataagaactccagtatttcttgtgaacccagcctacgatttttggcagattcaaaatgtcttggtaccaacttctgcggatccagataaaagttgggcaaagtgcagactcaatattaaggaatgtgatgccgcacagatgaaagttctacacggttttcgcagttctatgatggatgcgattggggaatttcatcagagcaaagatggtggcatgttcatagattcctgctatgctcattgccagacagtcatgtcagtgacatggcactccccaacctcaccaagaatcgaaaataagacgatcgcagaatctgtaggtgactggtacttcaaccgaaaaccggtgaagctaattgattgtccttacccatgcaatccttcttgttacaacatgaatttcacctgaagttgccttatactctcattttaccaatccctctgcttgtggactttttcgattctccagaagcttattcatccagggagcagtcgtttcctcaaaatcctcaatcc

SEQ ID NO: 66 - DNA, 1725 bp, Arabidopsis lyrata
agtcacccatcttatctctcccctcctttgtccccaagaaaagtatttctctgtgtttgtgtagtttcctttaccgctgaattttctctccgttttgtgcttgaaacctcacccaaatcaccaagatcgatcaaaatcgaaacttacgtttcagaagatggtgcagtaccagagattaatcatccaccatggaagaaaagaggaaaagtttagagtttcagcagaggaaagtggtggaggtggttgctactctaagagagctaaacaaaagtttcgctgccttctctttctctctatcctctcttgctgtttcgtcatgtctccttattacctcttcggcttctctactctctccctcctagattcgtttcgcagagaaatcgaaggtcttagctcttatgagccatttattacccctctctgctcagaaatctccaatggaaccatttgttgtgacagaaccggtttgagatctgatatatgtgaaatgaaaggtgatattcgtacaaactctgcttcttcctcaatcttcctcttcacctcctccaccaagaacaacacaaaaccggaaaagatcaaaccttacactagaaaatgggagactagtgtgatggacacagttcaagaactcaaccttatcaccaaagattcgaatagttcttctgatcgtgtctgcgatgtgtaccacgatgttcctgctgtgttcttctccactggtggatacaccggtaacgtataccacgagtttaacgacgggattatccctttgtttataacttcacagcattacaacaaaaaagttgtgtttgtgatcgtcgagtatcatgattggtgggagatgaagtatggagatatcgtttcgcagctctcggattatcctctggttgatttcagtggagatgcgagaacacattgtttcaaagaagcaaccgttggattacgtattcacgatgagttaactgtgaattcttcactggtcattgggaatcaaaccattgttgatttcagaaacgttttggatcggggttattcgcatcgtatccaaagcttgattcaggaggaaacagaggcgaatgtgaccgcactcgatttcaagaagaagccaaaactggtgattctatcaagaaacggatcatcgagggcgatattgaacgagaatcttctcgtggagctagcagaggaaacaggattcaatgttgaggttctaagaccacaaaaaacaacggaaatggctaagatttatcgttcgttgaacacgagcgatgtaatgatcggtgtacatggagcagcaatgactcatttccttttcttaaaaccgaaaaccgtattcattcagatcatcccgttagggaccgattgggcggcagagacatactatggagaaccggcgaagaagctaggattgaagtacattggatacaagattgcgccgaaagagagctctttatatgaagaatatgggaaagatgatcctataatccgagatccggatagtctcaacgataaaggatgggaatatacgaagaaaatatatctacaaggacaaaacgtgaagcttgacttgagaagattcagagaaacgttaactcgttcctatgatttctccattaggaggagatttagagaagattacttgttacatagagaagattaagaagcagaagaaagtgttacgtttttcttttgtaaagttgaatgacaattaaattcattttttttatcaag

SEQ ID NO: 67 - DNA, 1793 bp, Canola
cccggaggacgggccggtactccggggcgacacacgcgtcggaaagtttcctctgaattttctctctgattgcctaaaaacgtcacctaagttgatcaaacctttcatcaaaattaaaaactttggttctgggttttgctttgttgagccagagatggtgcagtatcatagattaatcatccaccatggaagaaaagaagagaggtttagagtttctgtagaggaagttggtagcttgaagaaagctaaacaaaagttcctctcttttctcttcctcacgatcctctcttgctgtttcatcgtgtctccttatctctttggcttctcaactctctctctcttagattcttttagcagagaaaacgaagctcttagttcttatgagccagccccagcccctgtctgcttagaagtctccaatggaaccatatgctgtgacagaaccggtttgagatcagacatctgtgtaatgaaaggcgatattcgaacagactctgcttcttcatcactcttcctcctcacctccaccaataacaccacaacccctcaaaagatcaaaccctacaccagaaaatgggagactagcgtgatggacacggtacaagaactcaacctaatcaccaaacattcaaacaaatcatcagaccatgtctgcgatgtctaccacgatgtccccgcagtgttcttctccacgggtggatacaccggaaacgtgtatcacgagttcaacgacgggatcatccctttgtttataacttcgcaacattacaacaagaaggttgtgtttgtgatcgtcgagtatcatgactggtgggagatgaagtacggagatatcgtctcgcagctctctgattatccattggttgactttaatggagattcaagaacgcattgtttcaaggaagcaacggttgggttacgtatacacgacgagttaacagtgaactccacgctaatgagtcatggtaacaaaaccattgttgacttcagaaacgtttggaccgtgcttacacgcatggtatccaaagcctggttcaagaggaaacaaaaacaacgcttgacgtcaagaagccgaagctggtgatattgtcgagaaacggttcaagagcgatactaaacgaggaccttcttgtcaagctagcggaagagacagggttcagtgtcgaggttctaagacctaacaaaagaacagagatggctaagatctatcgttcgatgaacacaagcgatgtaatgatcggtgtgcatggagctgcgatgactcacttccttttcttgaaacctaaaagtgtttttattcagatagttcctttagggactgattgggcggctgagacatactatggagagccagcaaagaagctagggttgaagtacattggttacaagattatgccgcaagaaagctctttatacggtgagtatggcaaagatgatcctgtcatcagagatccggatagtctcaatgataaaggatgggaatatactaagaaaatctatctacaaggacagaacgtgaagcttgacttgagaagatttagagaaacgttagctcgttcttatggtttctctattagaaggagagttagagaggaagttcctcgtttgtttgtttcatagagaagagtaagaagaaagtataacattcttttgtaaagttttttaaaaacattttattcatttttttttaagtatttggtgtatgacataattattatttcactcatcagcatatagataacttcatacagcattcagtcaaaaatgaaatgcactaaagcctgaaggtatct

SEQ ID NO: 68 - DNA, 2112 bp, Glycine max
cgactgtccagaaaataagaaagagtattatattatcatggcctaccaactttccctctaatttgatttaaccctttacggctatattgacagtagccttctccacacttaaattaaattgagtatttgtatccatccatccatttgtacatttcaattcagttcatttctataatcaatctctctctctctctctctcaatgacgctcaacatagcggctttggctgtgttgtgtatttctgtctttggcatcgctgtggtggctgaagatccatataggttcttcacctggaatgttacatacggagacatttatccacttggtgttcgccaacagggaatacttatcaacggtcaattcccaggtccagacattcattctgttaccaacgacaacctcatcatcaatgtcttcaacagcttggaccagccatttctcctctcctggaacggagtccagcagagaaggaactcattcgaagatggggtattgggaacaacatgccccatcccagcaggagggaacttcacatacatacttcaagtgaaggatcaaattggaagcttctactacttcccatcccttgcattccacaaagctgctggtggttttggaggcattaggattttgagcaggcctagaattccagttcctttcgatgatcctgccggtgattacactgtcctcattggagattggtacaagctcaaccacacggatttgaagtctcagcttgatagcggtaggaagctgcctttacctgatggaatcctaatcaatggtcgtggctctaatggagcatatttaaatgtggaacaaggaaagacttacaggcttagaatatcaaatgtggggttggaaaattcgctgaacttgcgcatacaaaaccacaaattaaagctggtggaagtggaagggacacacacccttcaaactacgtactcatcccttgacgtccacgtgggccaatcttactcagttctggtaactgcggatcaacctgctcaggactactacattgtggtctcctctcgatttacctccacagttctcaccaccaccggaattctgcgctatagcaactctgcaggcccagtttcaggcccaccccctggtggacctaccatccaaattgattggtctttgaaccaggcccgctccatcaggaccaacctcacagcaagtgggcctaggcccaacccgcaaggctcctaccattacggtctcataaacacaaccaggaccatcatactgtcgggttcaccaggtatagtgaatggcaaacaaagatacgcaattaatagcgtgtcttacgttgctccggacactcctcttaagctcgccgactacttcaaaatccctggcgttttccgtgtgggaagcatttctgacaggcccactggcggtggcatataccttgacacatctgtgctgcaaactgactacagaacatttgtggagtttgtcttccaaaatgacgaagatatcattcagagctatcatctcgatggctactctttctttgtggttggtatggatggaggacagtggacacctgctagcaggaacacgtacaatcttcgagatgcagtttcgcggtccacaactcaggtatatcccaagtcatggactgctatatatattgcgcttgacaacgtgggaatgtggaacttgaggtctgaattttgggcacggcaataccttggccaacagttttacatgcgcgtttatacaacatcgacctcaatcagagatgaatatcctgttccgaagaatgcactactttgtggtagggcaagtgggagacacactcgacccctttgagctagcaagcaagcgccttcgagtatgaaaactaaagcagttaacttatctgcttctgatttttgaatttatttgtttcggtgctttcagttatttatgctatgctccgatggacatgtatgatttaaactacaagttaaatgaccccagctcgaggtcacattctttcccagaaaaaaagaagaagaagaaggaaacaatatattctattctctttgtaattttccgaaatttttactattattacatattaatgtcgtaagaaagttgtcatttagcacttcgc

SEQ ID NO: 69 - DNA, 2083 bp, Glycine max
taggcactccatttgtcgatttcattccatttgtaacctctctctctcccttcactacacttcattcattcattcaccagtcagaggcagaggccagagagtgtggtgtgtgtgtgtgtctctctctttctctgcttttgagtaattaaatgagagcaaaaatgacgctcaaaacagcggcggtggctgtggctatagtgtgcatttctgcctttagcatcactgtggtggctgaagatccatacaggttcttcaactggaatgttacatacggagacatttatccacttggtgttcgccaacagggaatacttatcaacggtcaattcccaggtccagacattcattctgttaccaacgacaacctcatcatcaatgtcttcaacagcttggaccagccatttctcctctcctggaacggggtacagcagagaaggaactcattcgaagatggggtattaggaacaacatgccccatcccaccaggagggaacttcacatacattcttcaagtgaaggatcaaattggaagcttctactacttcccatctcttgcatttcacaaagctgctggtggttttggaggcattaggattttgagcagacctagaattccagtccctttcgatgatcctgccggtgattacactgtcctcattggagattggtacaagctcaaccacacggatttgatgtctctgcttgatagcggtaggaagctgcctttccccaatggaatcctaatcaatggtcgtggttctaatggtgcatatttcaatgtggaacaaggaaagacctacaggcttaggatatcaaatgtggggttggaaaattcccttaactttcgcatacaaaaccacaaattgaaactggtggaagttgaaggaacacacacccttcaaactacgtactcatcccttgatgtccacgtgggccaatcttactctgttctggtaaccgcggatcaacctgctcaggactactacattgtggtctccactcgatttacctccacagttctcacctccactggagttcttcgctatagcaactctgcaggcccagtttcaggcccaccccctggtggacccaccatccaaattgattggtctttgaatcaggcccgctccatcaggaccaacctgacagcaagtgggcctaggcccaacccgcaaggctcctaccattacggtctcataaacacaaccaggaccatcatactgtcgagttcacctggtatagtgaatggcaaacaaagatacgcaatcaatagtgtgtcttacgttgctccagacactcctcttaagctcgccgactactttaaaatccctggcgttttccgtgtcggaagcttttccgacaggcccactggcggtggcatataccttgacacatctgtgctgcaaactgactacagaacatttgtggagtttgtcttccaaaacgacgaagacatcattcagagctatcatctcgatggctactctttcttcgtggttggtatggatggaggacagtggacacctgctagcaggaacacgtacaatcttcgagacgcagtttcgcggtgcactactcaggtatatcccaagtcatggactgctatatatattgcgcttgacaacgtgggaatgtggaacttgaggtctgaattttgggcacggcagtaccttggccaacagttttacatgcgcgtttatacaacatcgacatcaatccgagatgaatatcctgttccaaagaatgcactactttgtggtagggcaagtgggagacacactcgacccctttgagctagctagcaagaaccttgttgagtatgaaaattaaagcagttaacttatctgcttctgattttgaatttatttcttttctgtttcagtaattatgctatgctccgatggacatgtgtgatttaaactacaaatgaccccagctcgaggtcacattcttttccagaaaaaaagaagaaagaaatttactattattacatattaatgtcgtaagaaggttagcatttagcactccgcaaagcaatgtgtcattcatagtttcttttcttctctaattaaaatagttggat

SEQ ID NO: 70 - DNA, 2409 bp, Cacao
aagacttgttttgctattaagccgaacaaaaacaacaacgagcccatgtgggcgacaaacacaaatagtcagctaatgtgaggaccccaccaccgacacttcaatcccccttttttttctttcttttcctttttctcaaattttaattttccctccttttattgtgtttttggcctttgcggcttacatacactcacacccgtcgccctcctctgcaccacacttaaatattgcgccatccctcatcagtccctgctcctcccaacctcttctacccggggatcccactctctctttgtcttcctttcaccttcactgcaccaacaaactgagacccaaaaaaggagtctgtcgctttattttttactttttttatactcccagaatgccgcttaacttggcggtggcactgttttgtgccacagcttctcttttcgccattgccggtgctgacgatccctacaggttcttcaactggaatgttacttacggtgacatctaccctctcggcgtccgtcaaacgggtattctcatcaatgggcaattcccaggccctgatatccactctgttaccaatgacaatctcattatcaacgtgtttaacagcttagacgagccttttctcctttcctggaacgggatccagcagaggaggaattcttatgaagatggtgtatacggaacaacatgccctattccaccagggaagaacttcacatacattcttcaggtcaaggatcagatagggagcttctattacttcccctctcttgcattccacaaggctgctggtggtttcggagggatcaggatcctcagccgaccacggattccggtccccttcccggatcctgctggggattacactgttcttattggagattggtacaagtccaaccacacggatttgagggctcatctagatcttggtaagaagctacctttccctgatggaatccttatcaatggtcgtggacctggcggtgcctccttcaatgttgaacaaggaaaaacctacagacttaggatatcaaatgttggattgcaaaattctctcaatttccgcatccaaaaccacaagttgaagttggtagaagtagagggaacacacactctgcaaactacctactcatcgatagacattcacgttggccaatcatcctctgttttatttacagctgatcagcctgcacaagactattacattgtagtctccactcgcttcaccaacccggtcctcaccactacagcaactcttcgctatagcaattccgctggccctgtctctggtcctcctcctggtggacccaccatccaaattgactggtctttgaaccaggcccgctctatcaggactaaccttacagcaagtggaccaaggcctaacccacaggggtcataccactacggtctcattaacacaaccagaaccatcaggcttgcaaattctgccgggcaagtcaatggcaagcaaagatatgcagttaacagtgtttcctttgttcctgcggacactcctctgaaacttgccgactatttcaagatcggaggagtttttcgcgttggaagcatatccgataatccttatggcggagggatataccttgatacttcagttatgaatgcagactacagggctttcattgagattgtattccagaacgatgaggacattgtacagagctggcatcttgatggatactctttctttgtcgtcggtatggacggagggcaatggacagcagctagtaggaatcaatacaacctccgtgatgcaatttcacgttgcaccactcaggtgtatccaaagtcatggaccgccatttatgtggcccttgataatgtaggaatgtggaacttgaggtctgagttttgggcaagacagtacctcggacaacagttttatctgcgtgtatacacagactcatcttcactcagggatgaatacccgatccctaagaatgcacttctctgcggtagggcaagcggccgaagcacccgacccctgtgaggcaggatagaatcaaggatccaagagttgggtagagaaaacctgtccagcttaggtggataaagattgaatactagagttttgccttctgatcttgttgtttagcgcatcaatggtgctaatgcgaagtgcctagcatttatgagttagaactcttaagttactagacctcagctcgaggtcgcattctttcttactatagatttgtattcccaattgtattgtccaagttttcataccattaatccttattattattattatatatttagtcatcattgttatgtttgttaatcaaagtcttgcattatagtactgctttcagattcaaggcccatgggaaattcaacccatgttgaaagagcagtcttgaatcggaatgaaaccagttctcaatt

SEQ ID NO: 71 - DNA, 2133 bp, Glycine max
taagtacactatcggggagagagcaaagagtgttgtgttggtaattaagaaagagaggaaaaatgccgctcaagttggcgggaggagccactgtcggttcccttctcctatgtgttgctatttctctctttcacatcgctggggccgaagatccctacaggttcttcaactggaatgttacttatggtgacatttaccctcttggtgttcgccaaacgggaatattgatcaacgggcaattcccaggtccagatattcattctgttaccaacgacaacctcatcatcaatgtcttcaacagcttggatgagccctttcttctctcttggaatgggatccagcagagaaggaactcattcgaagatggtgtttttggaacaacgtgccccatcccaccagggaagaattttacttacatccttcaagtcaaagatcaaattgggagtttttactatttcccatcccttgcattccacaaagccgctggcggttttggaggcattaggattctcagcagaccaagaattcccgtcccattccctgatccagctggtgattacactgtcctcattggagattggtacaagtccaaccacacgactttgaaagcccgtcttgataggggcaagaagctgccttttcccgatggaatacttatcaatggtcgcggacctaatggagtgtctttaaacgttgaacaaggaaagacttataggcttagaatatcaaatgtggggctgcaacactcccttaactttagaatccaaaaccacaaaatgaagctggtagaagtggaaggaacgcacacccttcagacaacgtactcctctcttgatgttcatgtaggccaatcttattcagtgctggtaactgcggatcaacctgctcaggattattatattgtgttttcctcacgattctcctacaaggtcctcaccaccactggagtgcttcgctatagcaactccgcaggcccggtatcaggcccaccccctggtggacctacaatccaaattgactggtctttgaaccaggcccgctccattaggacaaaccttacagcaagtggaccgaggccaaacccgcaaggatcgtaccattacggtatgataaacacgacaaagacgatcatattggcgagttcggctggtcaagtaaatgggaagcaaagatacgcaattaacagcgtgtcttatgttgccccagacacccctcttaagctcgccgattacttcaaaatctccggtgttttccgccccggaagcatatctgacagacccactggtggcggcatttaccttgacacttctgtgttacaagctgactacagaacttttgttgagattgtcttccaaaacaacgagaaaatcgttcagagctaccatcttgatggctactctttctttgtcgttggtatggacgggggacagtggacacctgctagcaggaaccagtacaatctccgagatgcagttgcacgttgcaccacacaggtataccccttttcatggactgctatttatattgcccttgacaatgtgggaatgtggaacttgaggtctgagttttgggcacgacaataccttgggcaacagttatatttacgcgtttatacagcatcaacctcaatcagagacgagttccctgttccaaagaatgcaattctttgtggtagggctagtgggagacacacgcgacccctttgagctagcaagagtttaaaggttccacgcttgaagaggcattctagctttagaatacgaaaagtagttaacttatctacttctaattttatagttgagtgctttggtttttttattttatgctatgctccagtgggatgatgaatatgtaggttgtatccctaaatgaccccagctcgaggtcacattaattatttcccagagagagatagagagtgtgtgtgagagagaatatatattatattccctttgtattatctcggattttactagtattgttatcaagaagaagggtgaatcggattgcgaaagttggcgtttggaacctggctataagcagggtctgtgattcatttaattgttgtagcagtgcagaactttttaatttcaattgctatatgcctatatcttttttcaatattgacagcag

SEQ ID NO: 72 - DNA, 2015 bp, Gossypium hirsutum
tccctccctattcaccaaatcgtcattcactctctacccctttctgttaaagtctctcacgttcactctacagtaaagggaatatctcatttccttgtaaaaaaatgcagcttcactcggccgtggcattgatttgtgccactgtttctctttttgtcattgccggagctgaagatccctacagattcttcaactggaatgtcacttatggtgacattttccctctcggcgttcatcaaacgggtattctcatcaatgggcaattcccaggccctgatatccactctgttaccaatgacaacctcattatcaacgtctttaacagcttaaacgagcctttcctcctttcctggaatggagtccaaaacaggaggaattcatatgaagatggtgtatacggaacaacatgccctatccctccaggaaagaacttcacatacattctgcaggtgaaggatcaaataggaagcttctattacttcccctctcttgggttccacaaggctgctggtggttttggagggattaggatccttagccgaccacgcatcccggttcccttcccagatcctgctggagattacactgtccttattggagattggtacaaggccaatcacacggatttgagagctcaactggatagtggtaggaagctacctttccctgatggaatccttatcaacggccgtggacctggcggtgcttccttcaacgtcgaacaagggaaaacctacaggcttaggatatcaaatgttggattgcaaaattctctcaatttccgcatccaaaaccacaagttgaagttggttgaagtggagggaacccacactctccaaactacctactcctcaatagaccttcaccttggccaatcaatgtccgttttatttacagccgatcagcctgctcaagactattacattgtggtctcctctcgctttaccaacccggttctcacctcaacagcaactctacgctatagcaattcagccggtcccgtctccggccctcctcctggtggtcccaccatccaagttgactggtctttgaaccaagcccgctctatcaggactaaccttacagcaagtggaccaaggcctaacccacaggggtcgtatcactatggtctcattaatacgaccagaaccatcaggcttgccaattctgccggccaagtcaatggcaagcaaagatatgcagttaacagtgtttcctttgttccagcagacactcctttgaaacttgcagactttttcaaaatcgatggagtttatcgtattggaagcatatcagataaccctactggtggagggatataccttgacacttcggttatgaattcggactataggtctttcattgagattgtgtttcagaatgatgaggatattgtccagagctggcatctcgacggctactctttcttcgttgttggtatggacggagggcaatggacggctgctagtcggaacggatacaacctccgtgatgccgtttcacggtgtaccactcaggtgtaccccaagtcatggactgccatttatgtggcgcttgacaatgtaggaatgtggaacttaaggtccgagtattgggcgagacagtacctgggacaacagttttatttgcgtgtcttcacaacgtcaacttcactaagggatgaatacccgatccccaagaacgcactactctgcggcagagcaagcggcagaagaacccgtcccctttaaagccacccatacaataaatgatccgtagttggatagtcaaagctggtttacaaggatgaatgattggacagcagagttttagcgtataaacttatgaacagtgaaacaacacgattgttggttacgagtttaaaattactagacctcaactcgaggtcgcattctttcttactatacatttgtattcccaatgcattgttggaggtcatagatatctatttcttgttatttgtgtgaatcgatctttacattaagggatataaggtgatggttgcaattgcaagc

SEQ ID NO: 73 - DNA, 2016 bp, Vigna unguiculata
accgcacctaaatgtgagccacccctaatcatttctgacccttccccttccctttaaaccctctttgtcccttcacacactgtgttgttcgtaactaagaaactgcaacaatgcatctcaaattggcggaaaaagcttctgttgctgttcttctcttttctcttctttctatttctcactttcatttttctgtggccgaagacccctacagattcttcaactggaatgtcacttatggggacatctttcctctcggtgttcgtcaaaggggaatcttgatcaacggacaattcccaggtccagatattcattctgttaccaacgacaacctcatcatcaatgttttcaatagtttggatgagccttttcttctttcctggaatgggattcagcagagaagaaactcattcgaagatggtgtttttggaacaacgtgccctattccaccggggaagaatttcacttacattcttcaagtgaaggatcaaattggaagcttttattattttccatctcttgcgtttcacaaagctgccggtggttttggcggcattaggattctgagcagaccaaggattccggtgccgtttcctgatcctgccggcgattacactgttctcatcggagattggtacaagtccaaccacacgactctgaaagcccatgttgataacggtaagaagcttcctttccccgatggaatccttatcaatggtcgtggacctaatggagtggctttcaacgttgaacaaggaaaaacttacagactcagaatatcaaatgtggggctgcaacattcccttaactttcgcattcagaaccacaaaatgaagctggtggaagtggaaggaacacacactgttcaaactacgtactcctctcttgacgttcatgtgggacaatcttattcagtgttggtaactgcagatcaacctgctcaggactattacattgtagcttcctcacgattctcctacaaggttctcaccaccaccgcagttcttcgttatagcaactctgcaggcccagtatcaggcccaccccccggtggacctaccatccagattgattggtccttgaatcaggcccgctcaatcaggactaaccttaccgcaagtggaccaagaccgaacccgcaagggtcgtaccattacggtctgataaacacgagcaggaccatcgtactagcgagttccgctggtcaagtgaatgggaaacaaagatacgcactgaacagcgtgtcttatgttgccccagacacccctctgaagctcgcagattacttcaaaatctcgggtgttttccgcccgggaagcatatccgacagacccactggtggtggcatctaccttgacacatccgttttacaaactgactacagaagttttgtggagtttgtcttccaaaacaacgagaacatcgttcaaagctatcatctcgatggctactctttctttgtcgtcggcatggatgggggacagtggacacctgctagcaggaaccagtacaacctccacgatgcagtttctcgttgcacgacacaggtatatccgatgtcatggactgctatttatgttgcccttgacaacgtgggaatgtggaacttgaggtctgagttttgggcacgacagtaccttgggcaacagttatatttgcgggtttttacaacatcaacctcaatcagagacgagttccctgttccaaagaatgcaattctttgtggcagggcaagcggtagacacacgcgaccactctgaagggttgacgctagtagaagaagcattctagccttagaatatgaagagtagttaactacttataattttattgttgagtgctttcgtttatttatggtagtgaaacgatgaatatgaatgattttactcctaaatgaccccagctcgaggtcgcattaattcttttccagagaaacatgtattatctccgattttacttgtgttgttgttcttgaggtgaatctgatttacaacttataattcatttcattgttgtgca

SEQ ID NO: 74 - DNA, 1670 bp, Manihot esculenta
ggttttgattggtaaatatgccgctaagcttagcgggaagagttgctgtttgtaccttgttgtgtgtcgctgtctctctttttgccaatgttggagctgaagatccgtacagattcttcaactggaatgttacttatggagacatatacccactaggtgttcgccaaacgggtattcttatcaatggacaatttccaggccctgatattcattcagttacgaatgacaatcttattatcaatgtgttcaacagcttagatgagccttttcttctctcctggaatggaattcaacaaaggagaaactcatatgaagatggtgttatcggaaccacatgcccaattcctccaggaaagaactttacatacattctccaagtcaaggaccaaataggaagcttttattatttcccatctcttgcattccacaaggccgctggtggttttggaggcatcagaatcctcagtcgcccaagaattccagtccccttcccagatcccgatggcgattacactgttcttattggagattggtacaagtctaatcacacggttttgagggctcacttggatcgtggtaagaagctgcctttcccggatggaattctcatcaatggtcgcggacccaatggttatgcacttactgtcgaacaaggcaaaacttacaggcttagaatatcaaatgttgggttgcaacattcacttaactttcggattcagaaccataaaatgaagttggtagaagtggaaggaacacatactcttcagaccacctactcttcacttgatgttcatgttggccaatcttactctgttctagtaacagctgaccagcctggtcaggactactacattgtggtttcctctcggttcaccactccgatcctcaccactactggtgttcttcactacagtaactctgctggtccagtttctggtccaccccctggtggacccaccattcagattgattggtctctcaaccaggcccgctcaattaggaccaatctcactgcaagtggaccaaggccaaatcctcaaggttcatatcattatggtatgatcaacacaaccagaactatcaggttcgcaagttctgctggccaagtaaatggaaagcagagatatgcagtgaacagtgtgtcctttgtcgcaccagacaccccactaaagcttgcagattacttcaaaattcaaggagttttccgcgagaatagcatatcagacaaaccttatggaggtggaatttatcttgacacatcagttttgacagttaattacagagagtttgtagaaattgtatttgagaacagtgaaaacattgtccaaagctggcatcttgatggttacagtttctttgttgttggtatggatggaggacagtggacatcagatagcaggaaccagtacaatctccgagatgcagttgcacgatgcaccactcaggtatatcccatgtcatggacagctatttacgtgccactcgacaacgtaggcatgtggaacttaaggtcagagttctgggctcgccaataccttgggcagcagctttacttgagagtttatacagcatcaacttcactgagagatgaatttcccattccaaagaacgcactcctttgtggtagagcaagcagtcggagcacacgacctctctaagctatagccaaa

SEQ ID NO: 75 - DNA, 2106 bp, Citrus
tcatcattcatcattcactactcacctcttaacttctttctttcctcttttatttttcaatttttcttttggaaaaaaaaaaaaactctctccccccccccccccaattcatcgcactaatctgaaaggtcacaaaagcaaacaagacttgacttagccttctgccttccccccaaaatgccgctaaacttagctgtcgctgcttcaatttgctccttgttttgttcccttttcgccattgtcagtgctgaggatccttacagattcttcaactggaatgtcacttacggcgacatctatccgctcggcgttcgccaacggggcattttgataaactggcaattcccaggccccgatattcactcagttacaaatgacaatcttattatcaatgtgttcaacagcttagacgagccttttcttctttcctggaatggaattcaaaacaggaggaattcatttgaagatggtgtatatggaacgacttgccctattcctcctgggaagaactttacatacattcttcaagtgaaggatcaaattggtagcttttactatttcccttcccttgcattccacaaagcagccggtgggtttggaggaataaggatccttagccgaccgcgcattcccgttcccttcccagatcctgccggcgattacactgttcttatcggagattggtacaagtccaatcacacggacttgagggcacatcttgataagggcaagaagctacctctccccgatggaattcttatcaatggccgggggagcggtgctgcttttaatgttgaacaaggaaaaacttacaggctcagaatatcaaatgttggattgcaaaactcactcaatttccgcattcaaaaccataagatgaagttggtagaagttgagggaacacataccctccagactacctactcatcacttgatgttcatgtcggacaatcatactccgttttggttactgctgatcaacctgcacgggactattacattgttgtttcctctcgcttcacctccactgtcctcaccaccaccggcattcttcattacagtaactctgcaggtccagtttcaggccccatcccaggtggaccaactgtccaaattgactggtcactaaaccaagcacgctctatcaggtctaatctcacagcaagtggaccaaggcctaacccacagggttcataccactatggtctcataaacactaccaaaactatcaggctttcaagttctgctgggcaagttaatggcaagcagagatatgcaatcaacagcgtgtcctttattccagctgacactcccctaaagcttgctgactacttcaagattggaggagttttccgcatcggaagcatttctgataatcctaccggtggagggatttaccaagacacagcagttatgggggctgactacagagcttttattgaaattgtgttccaaaatgatgaagacattatccagagctatcaccttaatggctaccaattttgggttgtcggtatggatggaggccaatggacatctgctagtagaaaccagtacaatctccgcgatgcagttgcccgtgtaaccgttcaggtgtatcccaagtcatggtctgcgatttatatagcactggataacgtaggtatgtggaacttgaggtctgagtcttgggcacgacagtaccttggacaacaattttacttgcgtgtttacacagcatcaacttcactcagggatgaatatcccatcccaaagaatgcacgtctttgcggcaaagcagctggcagacacacgaggcccctctaaattattatttaataaaatgatccaccgttgggtacgcaatttgtggattcgagtagaattttgatttctaatcttatattcgattagtttaatgttgctttgcttatttatgcgaggagtgtgtacaagtggaacttgaaattgaccccagctcgaggtctcattcttttctattgaaggttgtatttccgttgttacagcggtagctgttatagcattactgttagtattatttaaaattatgttgattctcatttatcaatttgataattggctcagccttttagtaatggaatgtaa

SEQ ID NO: 76 - DNA, 2204 bp, Citrus reticulata
ctctacactcacacatatcctctgcgccgcacttaaatacgtgccattcctcatcattcatcattcactactcacctcttaacttctttctttcctcttttatttttcaatttttcttttggaaaaaaaaaaaactctctccccccccccccccaattcatcgcactaatctgaaaggtcacaaaagcaaacaagacttgacttagccttctgccttccccccaaaatgccgctaaacttagctgtcgctgcttcaatttgctccttgttttgttcccttttcgccattgtcagtgctgaggatccttacagattcttcaactggaatgtcacttacggcgacatctatccgctcggcgttcgccaacggggcattttgataaactggcaattccccggccccgatattcactcagttacaaatgacaatcttattatcaatgtgttcaacagcttagacgagccttttcttctttcctggaatggaattcaaaacaggaggaattcatttgaagatggtgtatatggaacgacttgccctattcctcctgggaagaactttacatacattcttcaagtgaaggatcaaattggtagcttttactatttcccttcccttgcattccacaaagcagccggtgggtttggaggaataaggatccttagccgaccgcgcattcccgttcccttcccagatcctgccggcgattacactgttcttatcggagattggtacaagtccaatcacacggacttgagggcacatcttgataagggcaagaagctacctctccccgatggaattcttatcaatggccgggggagcggtgctgcttttaatgttgaacaaggaaaaacttacaggctcagaatatcaaatgttggattgcaaaactcactcaatttccgcattcaaaaccataagatgaagttggtagaagttgagggaacacataccctccagactacctactcatcacttgatgttcatgtcggacaatcatactccgttttggttactgctgatcaacctgcacgggactattacattgttgtttcctctcgcttcacctccactgtcctcaccaccaccggcattcttcattacagtaactctgcaggtccagtttcaggccccatcccaggtggaccaactgtccaaattgactggtcactaaaccaagcacgctctatcaggtctaatctcacagcaagtggaccaaggcctaacccacagggttcataccactatggtctcataaacactaccaaaactatcaggctttcaagttctgctgggcaagttaatggcaagcagagatatgcaatcaacagcgtgtcctttattccagctgacactcccctaaagcttgctgactacttcaagattggaggagttttccgcatcggaagcatttctgataatcctaccggtggagggatttaccaagacacagcagttatgggggctgactacagagcttttattgaaattgtgttccaaaatgatgaagacattatccagagctatcaccttaatggctaccaattttgggttgtcggtatggatggaggccaatggacatctgctagtagaaaccagtacaatctccgtgatgcagttgcccgtgtaaccgttcaggtgtatcccaagtcatggtctgcgatttatatagcactggataacgtaggtatgtggaacttgaggtctgagtcttgggcacgacagtaccttggacaacaattttacttgcgagtttacacagcatcaacttcactcagggatgaatatcccatcccaaagaatgcacgtctttgcggcaaagcagctggcagacacacgaggcccctctaaattattatttaataaaatgatccaccgttgggtacgcaatttgtggattcgagtagaattttgatttctaatcttatattcgattagtttaatgttgctttgcttatttatgcgaggagtgtgtacaagtggaacttgaaattgaccccagctcgaggtctcattcttttctattgaaggttgtatttccgttgttacagcggtagctgttatagcattactgttagtattatttaaaattatgttgattctcatttatcaatttgataattggctcagccttttagtaatggaatgtaaagcaaatcaaactacgaagaatgttgtgtttatcaggttttttattttt

SEQ ID NO: 77 - DNA, 2204 bp, Citrus Sinensis
ctctacactcacacatatcctctgcgccgcacttaaatacgtgccattcctcatcattcatcattcactactcacctcttaacttctttctttcctcttttatttttcaatttttcttttggaaaaaaaaaaaaactctctcccccccccgccccattcatcgcactaatctgaaaggtcacaaaagcaaacaagacttgacttagccttctgccttccccccaaaatgccgctaaacttagctgtcgctgcttcaatttgctccttgttttgttcccttttcgccattgtcagtgctgaggatccttacagattcttcaactggaatgtcacttacggcgacatctatccgctcggcgttcgccaacggggcattttgataaactggcaattcccaggccccgatattcactcagttacaaatgacaatcttattatcaatgtgttcaacagcttagacgagccttttcttctttcctggaatggaattcaaaacaggaggaattcatttgaagatggtgtctatggaacgacttgccctattcctcctgggaagaactttacatacattcttcaagtgaaggatcaaattggtagcttttactatttcccttcccttgcattccacaaagcagccggtgggtttggaggaataaggatccttagccgaccgcgcattcccgttcccttcccagatcctgccggcgattacactgttcttatcggagattggtacaagtccaatcacacggacttgagggcacatcttgataagggcaagaagctacctctccccgatggaattcttatcaatggccgggggagcggtgctgcttttaatgttgaacaaggaaaaacttacaggctcagaatatcaaatgttggattgcaaaactcactcaatttccgcattcaaaaccataagatgaagttggtagaagttgagggaacacataccctccagactacctactcatcacttgatgttcatgtcggacaatcatactccgttttggttactgctgatcaacctgcacgggactattacattgttgtttcctctcgcttcacctccactgtcctcaccaccaccggcattcttcattacagtaactctgcaggtccagtttcaggccccatcccaggtggaccaactgtccaaattgactggtcactaaaccaagcacgctctatcaggtctaatctcacagcaagtggaccaaggcctaacccacagggttcataccactatggtctcataaacactaccaaaactatcaggctttcaagttctgctgggcaagttaatggcaagcagagatatgcaatcaacagcgtgtcctttattccagctgacactcccctaaagcttgctgactacttcaagattggaggagttttccgcatcggaagcatttctgataatcctaccggtggagggatttaccaagacacagcagttatgggggctgactacagagcttttattgaaattgtgttccaaaatgatgaagacattatccagagctatcaccttaatggctaccaattttgggttgtcggtatggatggaggccaatggacatctgctagtagaaaccagtacaatctccgcgatgcagttgcccgtgtaaccgttcaggtgtatcccaagtcatggtctgcgatttatatagcactggataacgtaggtatgtggaacttgaggtctgagtcttgggcacgacagtaccttggacaacaattttacttgcgtgtttacacagcatcaacttcactcagggatgaatatcccatcccaaagaatgcacgtctttgcggcaaagcagctggcagacacacgaggcccctctaaattattatttaataaaatgatccaccgttgggtacgcaatttgtggattcgagtagaattttgatttctaatcttatattcgattagtttaatgttgctttgcttatttatgcgaggagtgtgtacaagtggaacttgaaattgaccccagctcgaggtctcattcttttctattgaaggttgtatttccgttgttacagcggtagctgttatagcattactgttagtattatttaaaattatgttgattctcatttatcaatttgataattggctcagccttttagtaatggaatgtaaagcaaatcaaactacgaagaatgttgtgtttatcaggttttttattttt

SEQ ID NO: 78 - DNA, 2230 bp, Ricinus communis
acttgcggctaattaaaaattcacaacacacactagtactggtacactcagacaggcacacacatcctctgtaccgcacttaaatattgcgccatccctcatcattcacttgcttcttccgggaacctaaatgtcacataatactcttttttaaactctgctctctctgcctttctttctcttgcctttcaattttgctataaaggagagcagcaaaaggcgttttctattggtggtttcgtcgttgtaatcattgtcattgctgcttcaaaatgccgctcagtttagcgggaactggtgctatttgcaccttgttctgcatcgctgtttctttttttgccattgttggagctgaagatccgtacaggttttttaactggaatgttacttatggtgacatatacccgctcggcattcgtcaacagggtatactcattaatgggcaatttccaggccctgatattcattctgtcacaaatgacaaccttattatcaatgtattcaacagcttagatgagccttttcttctctcctggaatgggattcagcagagaagaaattcatatgaggacggtgtttatggaaccacatgcccaattcctccaggaaagaacttcacatacattcttcaagtgaaggatcagataggaagtttctactacttcccgtctcttgcattccacaaggctgctggtggttttggaggtatcagaatccttagtcgtccgcgaattcctgtcccttttgcagatcctgacggtgattacaccattcttattggagattggtacaaatctaatcacacggacctgaaggctcatttggataatggtaagaagctaccattccctgatggaattctcatcaatggtcgagggcccagcggttattatcttactgttgaacaaggaaaaacatacaggcttagaatatcaaatattgggctgcaaaattcactcaatttccgcattcaaaatcataaaatgaagttagtagaagtggaaggaacacatactctccagactacctattcttcacttgatgttcatgtgggccagtcttattctgtcctatttacagctgaccagcctggtcaggactactacatcgtggtttcctctaggttcactactcaggtcctcaccaccacaggtgttcttcattacagcaactctgctggctcagtttctggcccaccccctggtggacccaccattcagattgattggtctctcaatcaggcccgctccattaggaccaatcttactgcaagtggaccaagaccaaatccacagggctcataccactatggaatgatcaacacatccaggactatcatccttgcgagttctgctggtcaagtgaacggcaagcagagatatgcagtcaacagtgtgtcctttattccacaggacaccccactaaagcttgcagacttcttcaaaattccgggagttttcaaggagaacagcatctcggacagaccttatggtggaggaatttaccttgacacgtcagttttgactgttgattatagagcatttgtagaaattgtatttcagaacaatgaagacattgtgcaaagctggcatcttgatggttacagtttcttcgtagttggtatggatggaggacagtggacatcagccagcagggatcaatacaatctccgtgatgcagttgcacgatgcaccgctcaggtatatccaatgtcatggactgctatttatgttccactagacaatgtagggatgtggaacttaaggacagagttctgggcacgccaatacctgggccagcagctctacttgcgagtctacacaacatcaacttcacttagagacgaataccccattccaaagaatgcactcacctgtggcaaggcaagcggccgacgcacacgacctctgtgagcaatggcgttattagtaattaaagggcagggaagcctgcttggttcggactcggaggatgaatggagagtagtagagttttgcatcttgtcttcctgttggctgctttacgtagttgggctaaatatgaagagaggagcacaaatatatatataaaatatttatatgtattgagtagaactattaatgacttcagctcgaggtcacattctttttcactaatgattgtattcccttgtttctttggcaagtttccacacattatttatggtgtattataaggttttaaaggcagctaattctcatgctgcttccgg

SEQ ID NO: 79 - DNA, 1886 bp, Canola
ggagactcaaatctgtgtacatgtaaagagctagagatcacgccaagaaatacctttcttcattcaccaaaaaaacatggcggccaatgcctcattcgccgccgcattaatcgtcggctttgcgcttcttttcgccgtcacggcggaaagtccgtataggttcttcgaatggaacgtcacttacggtgatatctacccactcggtgttcgccagcagggcattctgatcaacgggcagtttccgggaccggacattcactccgttactaatgacaatctcatcattaacgtctacaatagcctggacgaacctttcctcctttcatggaatggagttcaacagaggaggaactcgtacgtggacggagtgtacgggacgacttgccctatcccaccggggaagaactacacttacattcttcaagtgaaggatcagatcggaagtttctactacttcccttctctcgctttccacaaagccgctggtggttttggtggcctccgtatcctcagccgtcctggtatccccgtccctttcgctgaccctgccggagataacacagttctcatcggagactggtacaaatctaaccacacggatttgaaggcacagcttgatagtggtaggaagcttcctttaccagatggcatcctcatcaatggacgtgggagtggtgcaactctcaatgttgaacaaggtaagacatacaggttgagaatatccaatatagggctacaacactctctcaacttccgcattcagaaccacaagatgaaagtggttgaagtggaaggaactcacactcttcagactactttctcttctctcgatgttcacgttggtcagtcttactcggtccttgtaaccgccgaccagcctgcacaggactattacgtcgtggtctcttctaggtttacctcggatgtcctcaccaccactggtgttctccgttacagtggttctgctggtggtgtttctggacctattcccggtggaccaacaatacaaatcgactggtctttgaaccaggctcgagccatcaggactaaccttacggcgagtggaccaaggccaaacccacaaggatcataccactacggtatgataaacaccacaagaaccatcagacttgctagctctgctggtcaggtcaacgggaagcaacgatacgctgtgaacagtgtatcgtttaacccggcagacactcctttgaaactcgcggactacttcaagatcgacggtgtttacagagttggaagcatacagagccaacccactggtggaggaatctacctcgacacatctgttatgcagaccgattacagaacctttattgagattgtgttcgagaactctgaggatattgtccagagctggcatcttgacggttactctttctgggttgttgggatggacggtgggcaatggactcctgatagtaggaacgagtacaatctacgtgatgcagtagctcgctgcaccgttcaggtgtatccgagttcatggacggctatatacatagcactggacaacgtagggatgtggaatctaagatcagaattttgggcaaggcagtacttaggacaacagttctatctacgtgtctacacaacgtccacttctcttagggatgagtacccaatccccaaaaacgctcttctttgcggtagagctagtggtcgtcgcaccagaccactttgagcggtggagagataaagagagatggtcaacaatgccagctgattcgttgtggacgagtgttttcttgttttattcattcttcattttgctaatggatggaagagttgttgtcaaatcattatgtcagtttgtaacgatctcagctcgaggtctcaattcttattctttctttttatataaaaaa

SEQ ID NO: 80 - DNA, 2198 bp, Prunus
cctcttttaaactcacaaacacactccctcctatcatatagctttttcctaagtccaaccattccaatccaatacaacacaccaaagagccaaacactacactagtatttatactctctctctctcttctgtctctctctcacagagacagagacagagtcattgacttaaaacctcagcaagtaaggctccctccctccctcacgcatacaaatgtcgctcaactttgcgggagctgcggtttccgcactgctatttctcactagtctgttttccattgtcgctgctgaagatccgtacaggttcttcgaatggaatgttacttatggcgacatctacccacttggtgtgcgccaaaaggggatactcatcaatggtcaattcccaggcccagatattcactctgttactaatgacaatctcatcatcaatgtcttcaacagcttggacgagccatttctcatctcctggaatggaattcaacagagaaggaattcatttgaggacggcgtgtacggaacaacatgtccaataccaccagggaggaactttacctacattctacaagtcaaggatcaaattgggagtttctactatttcccatctcttgcgttccacaaggctgctggtggttttggaggcatccgaattctcagcaggcccagaattcccgtccctttccctgatccagctggtgattatactgttcttattggggattggtacaagtctaatcacacgagcttgaaggctcatctggacgctggtaagaagctgcctttccctgatggaatcctcatcaacggtcgcgggcccggtggattttcttttaatttcgaacaaggcaaaacttacaggctgagaatatccaacgttgggttgcaacactccctcaacttccgaattcaaaaccacaaattgaagctggtagaagtggagggaacacacaccctgcaaaccacctactcatcgcttgatgtacacgtgggccaatcttactccgttctagtaaccgctgatcagcccgggcaagactactatattgtggcttcctctcgtttcaccactccaatactcaccaccaccggcactcttcattacaccaactctgctggccgagtctctggcccaccgcccggtggacctaccatccaagttgactggtctttgaaccaggcccgctctatcaggaccaatcttacagcaagtggacccaggccaaacccacagggttcctaccactatggactgattaacacaaccaagacttacgtgctggaaaattctgccggtcaagtgaatggcaagcaaagatatggagtgaatagtgtgtcgtttgtcccggcagacactcccctcaagctggcggactacttcaaaattggaggagttttccgcgtgggaagcatctctgacaggcctactggcgggggattgtaccttgacacctccgtcttgggtgctgattacagaaccttcgtcgaatttgtgttccaaaacaacgaagacatcattcagagctggcatcttgatggttactctttctttgttgttggtttggatggagggcagtggacgcccgctagcaggaaagagtacaatctcagagatgcagtttcacgttgcaccgttcaggtgtatcccaagtcatggacggcaatatatgtagcacttgataacgtaggaatgtggaacttgaggactgagttttgggcacggcaataccttggacaacaattatacctgcgtgtttatactccctcaacttccattagggatgaataccccatccccaagaatgcactcctttgcggtagagcaactggccgacgcacacgacctctctaaatttaagccaccacacttggaagaacagggcctcctctgttctgttctgtgagtatctagctagcttgcttagtggatccatcaagattgaacaacgtcagtatcttactgtttgtttgcttcttctaatttattctactatttatgatgtcaaacgcggaggacatgtagcatttcaactgtcaaggacctcagctcgaggtcacattcttttttacaacacattttgtattccccttattgtttgaggttttcatgtaccaaattaaattatttatggtaaggccgggggtgacccaccctcaagttgcccctcatctcaacttttctattcttacctttgctactta

SEQ ID NO: 81 - DNA, 1936 bp, Gossypium hirsutum
attttatacttccaaaatgcagcttcatttggcggtggtattgctttgtgccacagctgggctttttgccattgccggtgctgaagatccctacagattcttcgactggaatgttacctttggtgacatttatcctcttggagttcgccaaacgggtattcttatcaatggtcaattcccgggccctgacattcactctgttaccaacgacaatctcattatcaacgtccataacagtttaaacgagccttttcttatttcctggagtggaatccaacagaggaggaattcttatgaagatggtgtatatggaacaacctgtcctattccaccaggaaagaacttcacatacattcttcaggtcaaggatcagataggaagtttcttttacttcccctctcttgcattccataaggcttctggtggttttggagggatcaggatcctcagccgacctcggatcccggttcccttcccggatcctgctggagattacactgttcttgttggagattggtacaagtccaatcacacgaatttgaaagctcgtctggatcgtggtaagaagctgcctttccctgatggaatccttataaacggtcgaggacctggcggtgcctccttcaacgttgaacaggggaaaacctacaggcttcggatatcaaatgttggattgcagaattctctcaatttccgcatccaaaaccatcggttgacgttggtagaagttgagggaacccacactttgcaaactacctactcttcaatagaccttcaccttggccaatcatgttcagttttatttaaagctgatcagcctgcaaaagattattacattgcagtctccactcgcttcaccagccgggtcctcacctctacagcaattctccgatatagcaattccgctggccctgtctctggtcctcctcctggtggaccaactatccaaattgactggtccttgaaccaggcccgctctatcaggactaaccttacagcaagtggaccaaggcctaacccacagggttcatatcactacggtctcattaacacaaccagaaccatcaggcttgcgaattccgccgggcaagttaacggcaagcaaagatatgcagtaaacagtgtttcatttgttccagcagacacacctctgaaacttgctgactatttcaaaatcggaggagtttttcatgtaggaagtatatctgataatccttatggcggaaagatataccttgatacttcagtaatgcaagctgactacagggctttcattgagatagtgtttcagaataatgagaacattgtacagagttggcatcttgatggctactctttctttgttgttggtatggatggagggcaatggacaacagctagtaggaggggatacaatctccgtgacgcggtttctcgatgtactactcaggtgtatcccaagtcatggactgccatttatgtggcacttgacaacgtaggaatgtggaacttaaggtcggagttttgggcaagacagtatctgggacaacagttttatttgcgagtatacaccacctcaacttcgctaagggatgaatatccgatccctaagaatgcactactctgcggtagggcaagtggccgacacacccgacccctctaacccagcatataataaaatctccaggtttgggtttaggattgaatagcagagttttggcattaatgttgctagtgtgaactatggaggaacttttatgcttttaaccttaaattaatagacctcaactcgaggtcgcatttttttttcttctaatagacttatgttcttattgtttctttcagttttcatttttcaaccattaattatgatgcactatcataattcatatttctattaacgttaaaatatctctaccatgtaattgtattttgtatttttaaggaatttagtcta

SEQ ID NO: 82 - DNA, 2120 bp, Medicago
acaactatttagagtaagcattgccgcgtagagaggcaaaagattttttgttagttaagtgtgtgggagcaaaatgactctcaatttagctgctgttggagccttgcttctatgtgtttctacttctttgtttcacattacttcagctgaagatccctataaattcttcaactggaatgttacttacggtgacatttacccacttggagttcgtcaaaggggtatattgatcaatggccaattccctggtccagacattcattctgttacaaacgacaacctcattatcaatgtcttcaacagtttgaatgaaccctttctcatctcatggaatgggatccagcagagaaggaactcattcgaagatggtgtttcgggaacaacatgccccatcccaccagggaggaacttcacatatattcttcaagtgaaggatcaaattggaagcttttactactttccatctctagcatttcaaaaagcagctggtggttttggaggcattaggatactcagtagacctagaattccagtccctttccctgaaccagctggagattacactgtccttattggtgattggtacaagtccaaccatacgactctgaaagcccatcttgataagggaaagaagcttcctatacctgatggagtcctcatcaatggtcgtggacctaatggattatcattcaatgttgaacaaggaaagacttataggcttaggatatcaaacgtgggattgcaacattcccttaactttcgaattcaaaaccacaaattgaagttggtagaagtggaaggaacacacacacttcaaactacatactcctcacttgatgttcatgtgggacaatcttactcagtgctagtaactgctgatcaaccttctcaggactactacgttgtggcttccacaagattctcctctaagatcctcaccaccactgcggtgcttcgctatagcaattctgcaggcgcagtatcaggcccaccccctggtggacctacaatccaagttgattggtctttgaaccaggcccgctcaatcaggactaaccttacagcaagtggaccaaggcctaacccacaaggatcctaccattacggtctcataaacacaacaaagacaatcattctggctagctctcctggtcaggttaatggcaagcaaagatatggaataaacagtgtatcttatgttgtcccagacacgcctcttaagctcgctgattacttcaaaatctccggtgtttttcgcgttggaagcatatctgagagacccactggtggtggcctttaccttgacacatctgtgatgcaagctgattacagatcttttgttgagattgtcttccaaaacaacgagaacattgttcagagctatcatcttgatggctactctttctttgttgttggtatggatggaggacagtggacaacttctagcagaaacgggtacaatcttcgagatgcagtagcgcgttgcaccactcaggtatatccctattcatggacggctatttatgttgcacttgacaacgttggaatgtggaacttgaggaccgagttttgggcacgacagtatcttggccaacaattttatttacgcgtttacacagcatcaacctcaatcagagacgagtttcctattccaaagaatgcacgtctttgtggtagggcaagtgggagacatacccgccccctttgagctagcaaaggtttaaaagcatccattccatgcttgagaaggcattatagctttagagtcgtgaaaagtagttaacttatctacttctatttttattgtttgaatgtttcaaatatatatgttgtgctcctgtcgaatcaagaacgaccaccacgtttgagtctgaaagacctcagctcgaggtcacattctttcccagccgaaaaagaatactatatatatatgttccctttgtattatctaaaattttactagtattattataaagtatggtgaaaagaattgcagaagttggtatttcacacttagctaagcagctgattcatttgatgtattgaacgtggaactctatgagtttcaattgctataatataatatacatatccttttcacttccgcggtgtctttttgt

SEQ ID NO: 83 - DNA, 2138 bp, Malus
gcgattatgtcataatccattcactccttccctttccctcacttctcttttgaaagtcactctccacagctctccttttcccttattattccaatatcaacccatcccaacacctccaaaatctctccgtcagtcattagcttaatcacgtagtcgtacgcataactaaaatgccgctaaacggagcggaaggtgccatctgggcactgctatgtctcgccgctctcttctccatagccgtcgctgaagatccctacagattcttcgaatggaatgtcacttacggcgacatttaccctctcggtgttcgccaaaagggaatactgataaatggacagttcccggggccagacatccactccgtcaccaatgacaatctcatcatcaacgtcttcaacagcttggacgagccgttcctcctctcctggaacggaatccaacaaagaaggaattcatttgaggacggagtgtatggaacaacctgcccaattccaccggggaagaacttcacctacattctccaagtcaaggaccaaatcggaagtttctactacttcccatctctcgccttccacaaggctgccggcggcttcggaggcatccgaattcttagcaggcccagaattcccgtccctttccccgatcctgccggtgattacactgttcttattggtgattggtacaaggctaatcacacgaccttgaaggctcatctggaccgtggtaagaagctacctttccctgatggaatccttatcaacggccgcggtcctggtggattctctcttaattttgagcaaggaaaaacatacaggctcagaatttcaaacattgggttgcaaaattccctcaacttccgcattcaaaaccacaaaatgaagctggtagaagtggagggaacacacaccctccaaaccacctactcatcccttgatgtacacgttggccaatcctactcggttcttgtaacagctgatcagcctggacaagactactaccttgtagcttcctctcgtttcacctctccaatcctcaccacaaccggcactgttcattacgccaactctgctggcaaagtctctggcccaccccctggtggacctaccatccaagtcgactggtctttgaaccaagcccgctctatcaggaccaatcttacagcaagtggaccgaggccaaacccgcagggctcgtaccactacggactgatcaatttaaccaaaacttatgtgctacaaaattccgctggtcaagtgaacggtaagcaaagatatggggtgaacagcgtgtcgtttgttccagcagacactcccttgaagctcgcggactacttcaaaattggaggagttttccgtgttggaagcatctccgacaggcctactggtgggggattgtaccttgacacctcagtattgggtgctgattatagagcattcgtcgagattgtgttccaaaacaacgaagatataattcagagctggcatctcgatggttactctttctttgttgttggtatggatggagggcagtggacaactgctagcaggaatgcgtataatctcagagatgcggtttcacgttgcaccactcaggtgtatcccaagtcgtggacggctatatacattccgctagataatgtgggaatgtggaacttgaggacagagttttgggcacgacagtaccttgggcaacagttatatctgcgtgtttatactccatccacttcaattagggatgaataccctattccaaggaatgcgcggctatgtggcagagcaagcggccggcgcacacgacccctctaagctctaaactaggggctacgccagcaaagtaggagtgagtgaagggcctctgcgatggagttttagctttagctgattgagatagaacaacagtcaactccactgttgcttcaaatttgatttttcaggggtgctgtttgattacgatatataaatttatgtcgcatgatcgcaactgtcaaagacctcagctcgaggtcgcattaattctttcctataacagattgattgtataccttttgttattgtaccaggttttcgtctgcctaattagtaattatgatcaggttgggtgaccctcctgttctcaacttgtttctcaaaaaaaaaaaa

SEQ ID NO: 84 - DNA, 2168 bp, Populus
acttaaatatcgcgccatccctcatcatttagaacctccttccaagaaactaacctcccttgctcctcttttaaagtcccactctcttcatcaccctcctttctatacgcagcagcactactaaaacaagaggcaaaccaaagagtcttaataactttgtcatttggctccaaaatgccgctcaacttagcgtgcaaacctgcagtactctgcacgtttttgtgtctcacagtgtctattctttcagttgtgaaagctgaagatccttacaggttctttgactggaatgttacttatggtttcatctaccctcttggtgttcgtcaacagggtattcttatcaatggacaattcccaggccctgatattcactctgttaccaatgacaacctcattatcaatgtctataacagcttagacgaacctttcctcctctcctggaatggaattcaacagaggagaaattcatacgaggatggtgtttttggaactacatgcccaattcctccaggaaagaactttacatacatcctccaagtcaaggatcaaataggaagtttctactacttcccatcccttggattccacaaggctgccggtggatttggaggaattagaatccttagtcgaccacgaattcctgtgcctttcgatgatcctgccggcgattacaccattcttattggagattggtacatgtccaatcacacgaaattgaaggctatattggacagtggcaggaagctcccattccctaatggaatcctcatcaatggtcgtggacgcaatggctattcactcactgttgaacaaggaaaaacttacaggttgagaatatcaaatgttgggttgcaaaattccctcaacttcaggattcaaaaccacaagatgaagttggtagaggtggagggaacacacactctccaaactacctactcctctctcgatgttcatgttggccagtcttattctgttctatttacagccgaccaacctggccaagactattatattgtggttacctctcggttcactgctccagtcgtcctcaacaccactggtattctacactatagcaactctgctggcccagtctctggtccattccccggtggaccaaccacacaaattgactggtcactcaaccaggcccgctctatcaggactaatcttactgcaagtggaccaaggccaaatccacaaggttcataccactatggaatgatcaacactaccagaactatcatagtggcaaattcagctggtcaagtcaatggcaagcagagatatggagtcaatagcgtgtcctttattgcaccagacactcccatgaagctcgcagactacttcaaaattcagggagttttcaaggagaatagcatatctgacagaccttatggtggaggattgtacctggacacgtcagttctgactcttccttatagagcatttgtggaaattgtattccaaaacaatgaggacattgtgcagagctggcaccttgatggttacagtttctttgttgttggtatggatggaggacagtggacaacagctagcaggaatcagtacaatcttcgcgatggagtttctcgatgcactattcaggtatatcccaaggcctggactgctatatatattccgctcgacaacgtggggatgtggaacttgaggacagaattctgggcacgtcaatacctcggtcaacaattttacttgcgagtttatacagattcaacttcactcagagacgaataccccattccaaagaatgcacttctttgtggtagggcaagtggtcgacacacaagacctctgtaagctagctcttcactgaaggagccaccaattaggccggtgagtatgtctagtttcggaggacgaagagtagattcttgcatctcatcttcgctgttgagttgctttacttaggctacgagtatcaaatgaaaagcttgtatggttataattccaattgatctcagctcgaggtcgcattctttttcccctaatgattgtattctcttctatattggttaagttctcatacattatttatatttttatatcaagccagctaattctcaaagttggctagggtaattagtgtgtgtttgtttcatgcattggatcagtttactcttaatactatattaatctcttctcta

SEQ ID NO: 85 - DNA, 1922 bp, Vitis
ggccctgaattctttccgggcctttctatctatcttttctctcctcttcaccattgtcgccgctgaagatccctacagattcttcacctggaatgtcacattcggcgacatttatcctcttggtgttcgtcaacagggaatcttgatcaatggccaattcccaggtcctgatatctactccgttaccaacgataatctcattatcaacgtctacaacagcttgactgagccttttctactctcctggagtggcgttcaacagaggaggaactcgtacgaagatggtgtgtacggaacgacatgcccaatccctccggggaggaacttcacctacattctccaagtgaaggaccaaatcggaagcttcttctacttcccttctcttgatttccacaaggccgccggcggtttcggcggcatccgaatcctcagccgccctagaatccctgtccccttccccgatcccgccggcgacatcaccgtcctcatcggagattggtacaaagcaaatcacacgacactgaaggccattctagaccggggtaagaagcttcattttccagatgggatcctcatcaacggccgtggtcccaatggagtctctttcactgtggagcaaggaaaaacatacaggttcaggatatcaaatgttgggctgcaaaattcactcaacttccggattcaagatcacaagatggtgttggttgaagtggagggaacacacactctccaaactacctattcctcccttgatgttcatgttggacagtcctactctgtgctagtgactgctgatcagcctgcccaggacttctacattgtggtctcaacacggttcacctctcaggtcctcaccaccaccggtattctccgatacagcaactctgctggtccagtctcaggcccacccccaggtggacccaccatccaaattgactggtcccttaaccaggctcgctctatcaggactaatcttacagcaagtggaccaaggcctaacccacaaggctcttaccactatggtatgatcaccacctccagaacaatcaggcttgcaagctctgctggtcaggtcaatggcaagcaaagatatgctgttaatagtgtatcctatgtcccaggggacacacccctaaaagttgcagacttcttcaagattggaggagttttccgtgttggaagcatatcagacaatcctactggtggaggagtataccttgatacttcagttatgggagctgacttcagagcattcgtagaaattgtgtttgaaaatcctgaggacatcatacagagctggcacatcgatggctactctttctttgtagtcggaatggatggaggattgtggacagcaaatagtaggaaccagtacaatctccgtgatgcagttgcccgttccactactcaggtatatcccaagtcatggactgcaatttacgtggcactcgataatgtgggaatgtggaacgtgaggtctgagttctgggcaaggcaatacctaggacaacaattttatctacgggtttattcgccagtagagtctatcagggatgaattcccaattccaaagaatgcactgctttgtggtaaggcaagtggtcgacgaacaaggcccctctaagagccagcggcaagccaccaaagctctggaagtgttaggggaaacctgtctggcataggaggattattaagagtagagatatgcatataatctttatgcgtgggagtttaaatgacctcagctcgaggtcacattcttttttaactaaaggttgtattttgttttgttactatttatgtattatgccattttataaagagaggtggttaaaacttattaaatatcctctatttgtaacagcaactttgtgtctctctctctttataataatattaggcaatttaccttgttacccgga

SEQ ID NO: 86 - DNA, 2067 bp, Arachis hypogaea
ccattacgccggggactaaccacaacaaatagagtaagtacaaagtagcatcagagagagagagagagagagtaaatagagggaaagagaaaatgccgctcaagttaggaggaggagctgctgcttttggcgccttcctagtcctatgtgttggtttttctctctttgcagttaccttggctgaagacccgtacaggttcttcaactggaacgtcacttatggcgatatttacccccttggagttcgccaaaggggaatacttatcaatgggcaatttcccggtccagacattcattcagttaccaatgacaatctcatcatcaatgtcttcaacagcttggatgagccttttctcctttcctggaatgggatccagcagagaaggaactcatttgaagatggagtgttaggaacaacatgcccaatcccaccagggaggaacttcacatacattctacaagtgaaggatcagattggaagcttctattacttcccatctcttaattttcataaagcagctggtggttttggaggaattaggatcctaagcaggcctagaattccagttccattccctgatccagatggtgattacactgttctcattggagattggtacaaatccaaccacactacgttgaaagctcatcttgatagaggtaagaagttgcctttgcctgatggcattctcatcaatggtcgtgggcctaatggagcatatctcaacgtcgaacaaggaaagacttacaggcttagaatatcaaacgtggggttgcaacattcgcttaactttcgcatacagaaccacaaattgaagctggtagaagtggaaggaacacacagcctacaaaccacatactcctcccttgacgttcatgtgggacaatcttattcggttctagttactgcagaccaaccagcacatgactattacattgttgtttccactcgattcaactacaagatcctcaccaccactggagttcttcactatagcaattctgggggccaagtttccggtccaatccctggtggacctaccatccaaattgattggtctttgaaccaggcccgctccataaggactaaccttacggcaagtggaccaaggccgaaccctcaaggatcataccattacggtttgataaacacaaccaagaccataattctggcaagttcagctggtcaagtgaaccgcaagcagagatatgcaatcaacagcgtgtcctatgttgccccagacactcctcttaaactcgccgactacttcaagatctcgggtgttttccgtgctggaagcatctctgacagaccctatggtggtggcatataccttgatacctctgtattgcaagctgattatagatccttcgttgagattgtcttccaaaacaacgagaatattgttcagagctatcatcttgatggctactctttctttgtggttggtatggatggaggacagtggacaactgctagcaggaacagttacaatcttagggatgcaattgcacgttgcacaacacaggtatatccttattcatggacggctatatatgttgcacttgacaatgtgggaatgtggaacttgaggtctgagttttgggcacgacaatatcttggtcaacagttttacttgcgggtttacacagattcaaactcaattagggacgaatttccagttccaaagaatgcacttctttgtggtaaggcaagtggaagacacacacgtcccctttgagctagaaaggattatttgatggatccatccaagtatccaaggcattctagctttagaatataaagagtagctaaattatgtgctgctaattttattgtttgagtgctttcacttttttatgatatgctctgctggaatgtttgaacatgtgtaattttatctttgtatgaccccagctcgaggtcacattctttcccaggaaaaagaaagagacagagaaagagagagagaagagagagagagaagctatatattatatatttttattccctttgtattatctcgatttttactagcattaaaagtaaggttatgcagattgcag

SEQ ID NO: 87 - DNA, 2181 bp, Gossypium hirsutum
tcctttacggcttactcacactttcaactgttcaacccatttaatatagcctcccttaaatattgtgccatcctatccccttattaactctttcagttcactgctcctgcccttttattctaaacctctccttttcccttccattagacccaaaatgccgcttcactcggcggtagcattgttttatgccgcagcttctcttttcgccattgctggcgccgaagatccctacaggttctacagctggaatgttacgtacggtgacatttaccctcttggcgttcgtcaaacgggtcttctcataaatgggcaattcccaggccctgatattcactctgttaccaacgataacctcatcatcaacgtctataacaacttaaacgaatcttttctcctctcctggaatggagtccaacaaaggaggaactcgtatgaagacggcgtgtttggcacaacctgccctattccaccaggaaagaacttcacatacatgcttcaggtgaaggatcaaatagggagtttctattactacccatcacttggattccacaaggcagctggtggttttggagggatcaggatccttagtcgcccacgaatcccagtccccttccctgacccggccggggattacactgtgctcattggcgattggtacaagtccaatcacacggttttgcaagctcatctggatggtggtaagaagctacctttccctgatggagtccttatcaatggtcgtggacctggtggtgcctccttcaatgttgaacaaggcaaaacctacaggcttaggatatcaaatgttggactgcaaaattctctcaatttccgcatccaaaaccacaggttgacgttggttgaagtggagggaacacacaccctgcaaacgacctactcttccatcgaccttcacctaggccaatcgtgctccgttttattcacagctgatcagcctgcacaagactattacattgttgcctctactcgcttcaccaaccccgttctcaccacgactgcgaccctacgttacagtaattctgctggccctgtctctggtcctcctcctggtggacccaccatccaaatcgactggtctttgaaccaggcacgctctatcaggactaaccttacagcgagtggaccaaggcctaaccctcagggctcctatcactatggtctcattaatacaaccagaaccatcaggcttgcaaactctgcgggacaagttaatgggaagcaaagatatgcagttaacagtgtttcctttgttctgccagacactcctttgaaacttgccgactatttcaaaattggaggagtcttccggcctgggagcatatcagataatccttatggtggagggatataccttgacacttcagttctgaatgctgattatagggcttttgttgagattgtatttgagaacactgagaacatcatacagagctggcatctcaatggctactctttctttgtcgttggtatggacggagggcaatggacagcagctagtaggaacggatacaacctacgtgacgcagttgcacgttgtactactcaggtgtatccaaaatcatggacagccatatatgtggcacttgacaacgtggggatctggaacttgaggtctgagtactgggcaagacagtaccttgggcagcagctttacttgcgtgtatacacagattcaacatctctcagggatgaataccccatccccaagaatgctctcctctgcggtagggcagctggccgaagcacccgaccgctctaagccaccatatgataaggaacgttgggtggtggatggatgaagatgattgaagagagtagagttttgcctctaatcttgatatgtatatctttaattatataatatagctcattatattgtgcttagcatgtaatattcaagtctaaaattaatggacctcagctcgaggtcgcattcttttactttagatcagatctgtattccctttgtattgttcaggtttccaaccataaattattggtactatcttattgttatcataattgacgtgtgtttaagttcaagtactgctttcacatgcataggagcaaagctaaaatggagcagctctttgctcttgttcttccagagaatgtgtgtatatattttgatcacttataagtattatttaagagttgaat

SEQ ID NO: 88 - DNA, 1929 bp, Raphanus sativus
ggatattcgttccctctcttctctccttcactcttacactcacatctgtgtacatgtaagagctagatatcacgcccaaagtatacctttcttcattcaccaacaaaaaaaaatggcggccaatgcctcattcgccgccgcattattaatcggcttttcgcttctcttcgccgtcatggcggaaagtccgtacaggttcttcgattggaacgtcacttacggtgatatctacccactcggtgttcgccagcagggtattctgatcaacgggcagtttccgggaccggatattcactccgttactaatgacaatgtcatcattaacgtctacaatagcctcgacgaacctttcctcctttcatggaatggaattcagcagaggaggaactcgtacgtggatggagtgtacgggacgacttgtcctatcccgccggggaagaactacacttacattcttcaagtgaaggatcagatcggaagtttctactacttcccttctctcgctttccacaaggccgccggtgcttttggtggcttccgtatcctcagccgtcctggtatccccgtccctttcgctgaccctgccggagattacactgttctcatcggagactggtacaaatctaaccacacggatttgaaagcacagcttgatagtggtaggaagcttcctttaccagatggtatcctcatcaatggccgtggaagtggtgccactctcaatgttgaacaagtaagacatacaggytgagaatatccaaygtagggttacaacactcvctcaacttccgcattcaaaaccacaaaatgaaagtggtcgaagtcgaaggaactcacactcttcagactaccttctcttctctcgatgttcacgttggtcagtcttactcdgtccttgtgactgctgaccagcctgcacatgactattacgtggtggtctcttctcggttcacctccactgtcctcaccaccactggtgttctccgttacagcggctcttcbggtggtgtctctggtcctatccctggtggaccaaccattcagatcgactggtccttgaaccaggctcgagccatcaggactaatcttacagcgagtggaccaaggccwaacccacaaggatcataccactacggtatgataaacaccacaagaaccatcagacttgctagcgctgccggtcaggtcaacgggaagcaaagatacgccgtgaacagcgtatcstttaagccagcagacactcctctgaaactcgctgacttcttcaagatcgatggtgtctacagagttggaagcatacagagccaacccactggtggtggaatttacctcgacacatctgttatgcaagcagactacagaacctttgtrgagatygttttcgagaaccctgagaatattgtccagagctggcatctagatggttactctttttgggttgttggaatggacggtggtaaatggagtcctgctagtagaaacgagtacaatctacgcgatgcattagctcgctgcaccgttcaggtgtatccgagttcatggacggctatatacatagcactagacaacgtagggatgtggaacctaagatccgagttttgggcaaggcagtacttaggacaacagttttatttacgtgtctacacaacttccacttctctsagagatgaattcccaatccccaagaacgctcttctatgtggtagagctagcggtcgtagcaccagaccgttttagagctaaggagatggtcaattaaaccagctgattcagtttgtaaacgatctcagctcgaggtctcaattgttattctttttaaaaataatatctagagtgaaactttattctatatatagttatatagttctgttgtgagtcttatattgacgtagtgttacagtttgctattatatgaatcttcagttaaca

SEQ ID NO: 89 - DNA, 2210 bp, Fragaria  ananassa
aatgtcctcgtcactaggtgctctctctgtcttaaagtcactctccagagctagcacttctctcatatccaccaaattatccaagaggcaaaatctctctgcctctgaagattcttttcaatcaccttaaaatccccctagacaacaaatgccgctaaacttaggtgccatctcggcactgctatgcctcagcctcacggccagtcttctcgccgttgtcaccgccgaagatccctacagattcttccagtggaatgtcacttacggcgacatctacccgctcggtgttcgccaaaggggaatactaatcaacggccagttccccggcccggatattaactccgtcaccaacgacaatctcatcatcaatgtcttcaacagcttggacgaacctttcctcctctcttggaatgggatccaacagagacataattcatttcaggatggtgtgtatggaacaacttgcccaataccaccagggaggaatcttacatacattctccaagtgaaggatcagattggaagtttctactacttcccttctcttgcatttcacaaggccgccggtggtttcggaggcatcagaattctcagccggccaaggattccggttccttttccggatccttctggtgactatactgttcttattggagattggtacaagtcgaaccacacgaccttgaaagctcatcttgatcgcggtaagaagctacctttccctgatggaatcctcatcaatggtcgcgggcccaatcaattttctctcacctttgagcaaggaaagacttacaggcttaggatatccaacgtggggttgcaacactcactcaacttccgcattcaagaccacaaaatgaagttggtggaagtggaaggaacacacaccctccaaactacttactcatctctcgatgtacacgtcggtcaatcttactctgttctagtaacagctgatcagcccggacatgactactacattgtggtttcctctcgtttcagcacgccgatcctcaccaccaccggcattcttcattacagcggtgctgggggacaagtctctggcccgatccctggtggacctaccattcaaattgactggtctttaaaccaggcccgctctattaggacgaatcttacagcaagtggaccaaggccgaacccacagggatcataccactatggactcattaacttaaccaaaacctacatcctagcgagtgctgctggtcaagtcaatggcaagcaaagatatggaataaacagtgtgtcgtttgtcccagcagacactccattgaaacttgctgactacttcaaaatcagtggagttttccgtgttggaagcgtctccgacaggcctactggtggtaatttgtaccttgacacgtcagttttgggagctgattacagaacatttgtagaaattgtgttccaaaatgatgaagatatagttcagagctatcatcttgatggttaccagttctttgttgttggcatggatggagggaagtggacaactgctagtaggaatgggtacaatctccgagatgcagtggctcgttccaccactcaggtgtatcccttctcatggacagcaatatatctttcacttgataatgtgggaatgtggaacttgaggactgagttttgggcacgacaataccttggacagcaattgtatcttcgtgtttacacatcatcgacttcaatcagggacgaataccccattccgaggaatgcacgtctttgtggcagagcaagtggccgacacacacgaccactctagagtccaatgcagcaactgagcaaagtgtgattagccctgtctagcttagtggttggaggacgaaggttggcgagtagagtgttgcttctaatttgttcttgggtcgccctttaattactatttatgatgtgaaatgaggagcatgcatgtaccatttcaagttttcaactgtggaggatctcagctcgaggtcatattcttttctagaccagattgttattccctttaaattgttatgtttcaggttttcgcccgtatacctaattaagcgattatatatgataaggttaggtgaccatgtagttgcctcgcaacaatttcattgatatgttgctacagataaatgagtacgctggctattgttgatatgagaaatatatatttcagaaactttctggaggatgtgattttaaccttgttcctg

SEQ ID NO: 90 - DNA, 1666 bp, Manihot esculenta
aaaatgccgctaagcttagcgggaactagagctgtttgcatcttgttatgtttagctgtcgcctctctctttgccattgttggagctgaagatccatacagattcttcaattggaatgtcacttatggagacatatacccactcggcgttcgtcaacgaggtatactaatcaatggacaatttccaggccctgatattcactcacatttaagcgctttaactattgggttcaatttagttgcgagtttaatgaactcagttgagatattgcagaatggaattcaacaaaggagaaactcatacgaggatggagtttatggaaccacatgcccaattcctccaggaaagaacttcacatacattctccaagtcaaggaccaaatagggagtttctattatttcccttctcttgcatttcacaaggctgctggtggttttggaggaatcagaatcctcagtcgcccacgcattcccgtccccttctcagatcctgacggcgattacaccattcttattggagattggtacaaatctaatcacacggatttgaaggctcaattagatggtggtaacaagctaccattccctgatggaattctcatcaatggtcgcgggcccaatggttatgcgcttactgttgaacaaggaaaaacttacaggctcagaatatcaaatgttgggttgcaacattcactaaactttcgcattcagaatcataaaatgaagttggtagaagtggagggcacacacactctccagaatacctactcttcactcgacgttcatgttggccaatcttactctgttctagtaacagctgaccagcctggccaagactattatattgtggtttcttctcggttcacgactcccatcctcaccaccactggtgttcttcactacagtaactctgctggtcctgtctctggcccaccccctggtggacccaccattcagattgactggtctctcaaccaggctcgctccattaggaccaatcttactgcaagtggaccaagaccaaatccacaaggctcataccactatggtatgatcaacacaaccagaactatcagatttgcaaattctgctggccaagtcaatggcaaacagagatatgcagtgaatagcgtgtctttattccagcagataccccactaaaacttgcagactacttcaaaattcagggagttttccgtgagaacagcatatcagacaaaccttatggaggaggaatttaccttgacacatctgttttgactcttaattatagagaatatgtggaaattgtattcgagaacaatgaagacattgtccagagctggcatcttgatggttatagtttctttgttgttggtatggatggtggacaatggacatcagatagcaggaaccaatacaatcttcgggatgcagttgcacgatgcaccactcaggtatatcccaaatcatggactgccatttacgtgccacttgacaacgtaggaatgtggaacttaaggtcagagttttgggctcgccaatacctaggccagcaactgtatgtgcgagtttacacaacatcatcttcacttagagatgaatatcccatcccaaagaatgcacttctctgtggtaaagcaagtggtcggaggactcgacctctttaagctatcgaaacagcggg

SEQ ID NO: 91 - DNA, 1880 bp, Malus
agctaattcgactgccgtacgcataactaaaatgcgggtaaacggagcgggaggtgcgatttcggcactgctttgtctcgccgctctcttctccatagccgtcgctgaagatccctacagattcttcgaatggaatgtcacttacggcgacatttaccctctcggtgtccgccaaaagggaatactgataaatggacagttcccggggccagacatccactccgtcaccaatgacaatctcatcatcaacgtcttcaacagcttggacgagcctttcctcctctcctggaacggaatccagcaaagaaggaattcatttgtggacggagtgtacggaacaacctgcccaataccaccggggaggaacttcacctacattctccaagtcaaggaccaaatcggaagtttctactacttcccgtcactcgatttccacaaggctgccggcggcttcggaggcatccgaattctcagcaggcccagaattcccgtccccttccccgatcctgacggtgattacactgttcttattggcgattggtacaagtctaatcacacgaccttgaaggctcatctggacagtggtaagaagctaccttctcctgatggaatccttatcaacggtcgcggtcccggtggattttctcttaatttcgaacaaggaaaaacgtacaggctcagaatttcaaatgttgggttgcaaaattccctcaacttccgcattcaaaaccacaaaatgaagctggtagaagtagagggaacacacaccctccaaaccagctactcatcccttgatgtacacgttggccaatcttactccgttcttgtaacagctgatcagcccggacaagactactacgttgtagcttcctctcgtttcacctctccaatcctcaccacaaccggcactgttcattacgccaactctgctggcgcagtctctggccctccccctggcggacctaccatccaagtcgactggtctttgaaccaagcccgctctatcaggactaatcttacagctagtggaccgaggccaaacccacagggctcataccactatggactgatcaacttaaccaaaacttacgtgctagaaaactccgctggtcaagtgaatgggaagcaaagatatggagtgaacagtgtgtcatttgttccagcagacactcccctgaagctcgcagactacttcaaaattggaggagttttccgtgttggaagcatctccgacaagcctactggtggaggattgtaccttgacacctcagttttgggtgctgattatagaacattcgtcgagattgtgttccaaaacaacgaagatataattcaaagctggcatcttgatggttactctttctttgttgttggtatggatggaggccagtggacaactgctagcagggatgcgtacaatctcagagatgcggtttctcgttgcaccactcaggtgtatcccaaatcgtggacggctatccacattgcgctcgataacgtgggaatgtggaacttgaggacagaattttgggcacgacagtaccttggacaacaattatatctgcgtgtttatacttcatccacttcacttagggatgaattccccattccaaggaatgctcggctatgtggcagagcaagcggccagcgcacacgacccctctaaactctaaattaaggcctatgccagcaaagtgcgagcgagtgaagggcctctgcgatcgagttttagcttatctggttaagatagaacaacagttaactcaactgttgctccttatttgatttttctggggtgccgtttgattacgacatatatttatgcagcatgatcggaattgtcaaagacctcagctcgaggtcacattaattctttccta

SEQ ID NO: 92 - DNA, 1971 bp, Arabidopsis lyrata
cgtgccgactctctacataaactctacactcaaatctgtgtctcaaatagagagagagagagagagaccacgccaaaaatacctttcttctttcaccggttttcataccaaaaaaatggcggccaatgcctcattcgccgccgcattactcattggactctcgcttctcttcgccgtcgtggcggaagatccgtacagattcttcgaatggaacatcacttacggcgatatctacccactcggagttcgccaacagggtatactgatcaacgggcagtttccgggaccggacattcactcagttactaatgataatctcatcattaacgtctacaatagcctcgacgaacctttcctcctttcatggaatggaattcagcagaggaggaactctttcgtcgatggagtgtatggaacgacatgtccaattccgccggggaagaactacacttacattcttcagatgaaggatcagatcggaagtttctactacttcccttctctcggtttccacaaagccgccggtggatttggcggtatccgtattctcagtcgcccgagaatccccgtccctttccctgatcccgccggagataccaccgtccttatcggcgactggtacaaatcaaaccacacggatttgagggcacagcttgatagtggtaagaagcttcctttaccagacggtatcctcatcaatggtcgttcaagtggtgccactctcaatgttgaacaaggtaagacatacaggttgagaatatcaaatgttgggttacaagactctctcaacttccgcattcaagaccataagatgaaagtgatcgaagtcgaagggacacatacccttcagactactttctcttcgctagatgttcatgttggccaatcttactcggtccttgtaactgcggatcaaactcctcgagattattacgtggtcgtctcttctcggtttacctctaatgtcctcaccaccacgggtattctccgttacagtaactctgctggtgctgtttctggacctattcccggtggaccaaccattcaaattgactggtccttgaaccaggctcgagccatcaggactaaccttacagcgagcggaccaagaccgaatccacaaggatcataccactacggtatgataaacactacaagaacaatcagacttgctagctctgctggtcaggtcgatgggaaacaacgatacgctgtgaacagtgtatcattcaaaccagcagacactcctcttaaaatcgcggactacttcaagattgacggtgttttcagaagtggaagcatacaataccaacccactggtggaggaatatacctcgacacatctgttatgcaagttgactacagaacctttgtggagattgttttcgaaaactctgaagatattgtccagagctggcatcttgatggttactctttctgggttgttggaatggacggtgggcagtggagtccagacagtaggaacgtgtacaatctacgcgatgcagtcgctcgctgcaccgtgcaggtatatccgagctcatggacagctatattaatagcactcgacaacgtaggaatgtggaacctaagatccgagttctgggcgaggcaatacttaggacaacagttgtatttacgtgtctacacaccctcgacttctctcagagatgaatatccaatccccaagaacgctcttctctgcggtagagccagtggtcgccgcaccagaccgctttgagcttgctgttagatagagagattacggagagatggtcagccaagccagctgacgcgttctggaggcgggtttcttgttttacacattcttcattttgctaatgaatgaaaagagtttggtaaaatcagtatatcagtttgtaacgatctcagctcgaggtctcattcttatattctttctttttctatggagcgaaacttttattcaatataattctacagtttcatcgt

SEQ ID NO: 93 - DNA, 1883 bp, Tragopogon
tacactttcctccctcctcccaatcccatactctcctcttccgccgatcagaatcatgccgcgaagcttcgcggcttgcatttccgtcgtagcacttctcgtcgccattgccggcgccgaagatccttacaggttcttcaactggaatgttacgtacggcgatatttatcctcttggagttcgtcaacaggggattttgattaatggacagtttcctggaccggatattcactctgttacaaatgacaatctcattatcaacgtcttcaacagcttgcccgagccttttcttatctcctggaatggagttcaacaaagaagaaattctttcgaagacggggtttatggcacaacgtgcccaattcctccgggtaaaaacttcacatacatccttcaagtgaaggatcagattggaagcttttactactttccttctttagcattccataaagccgccggcggttttggaggtattcgaatcttaagccgtcctagaatccctgtcccgtttgatgaacccgctggagattttactgttcttatcggagattggtacaaagcgaatcacacgaccttgaaaagagttctagataatggtcataagataccttttcctgatggtattctcatcaatggacgtggcccaaatggtgcctatttcactgtcgagcaagggaaaacttataggttaagaatatcgaacgtgggactgcaaaactccctcaacttccggattcaaaaccacaagatgaaattggtggaagtggagggaacacatacagttcaacaaacgtattcttctttggatgttcattgtgggcaatcttattcggtattgtttacggctgaccaaccgggtcacgactactatattgttgtgtcatcgcggttcaccactccagtccttacaacgaccggtgtccttcactatagcaactctggtggacaagtttcgggtccgatccctggtggacccaccatccaagttgattggtcccttaaccaagctcgttccatcagaaccaatcttacagcaagcggacctagaccaaatccacaaggttcataccattacggcatgataaacacaagccgaaccatcatcctccaaagttcagccggacaagttggcggcaaacagagatacggaatcaacagcgtctcattcaaaccagccgacactcccctcaaactcgccgactatttcaacatcggaggcgttttccgtgttggaagcatttccgatagacccaccggcggcggcctctaccaagatacatccgtcatgggcgccgattacagagctttcgttgaaatcgtctttgaaaaccctgccgacatcgtcctcagttatcacctcgacggctaccagttctttgttgtcggaatggatggtggacaatggacacaagctagcaggaacggatacaaccttcgcgatggagtcgcacgcagcacgatccaagtttacccaaaatcatggtcagcaatctacctaggacttgacaacgtcggaatgtggaacttaagaacagaattctgggcaagacaatacctcggagaacagttttatttacgtgtttacacaaactcaggttccatcagagacgaatttccgatcccgaaaaatgcacggctttgtggtagggctactggcttccacacacggcctctttaagattatgtggtttccacgtagaagaagaatttaattgattttggttttgttgtcattttagtagaattgtttatgatgacctcacctcaaggtcgcaattcttttttttccttttaactatttatatgagtgtgttggaacttcacagaaagaatctatattattgtaataaggaaaattgttacgagatattgttgtacatgtt

SEQ ID NO: 94 - DNA, 1641 bp, Cucumis sativus
tattcccataatccaaaatgcttcctcttacttcacctttctttgcactctgtgcatttttctgtttcttctccaccctctctgctgaaaatccctaccgcttcttcacctggaatgtctcttacgccaacatttaccctctcggcgtccgccagcagggaatactcatcaatggccaattccctggccctgacgtccactgtgtcaccaatgacaacctcatcatcaatgtcttcaacagcttggatgaacccttcctcatctcctggaacggaatccaacagagaaggaactcgtacgaagacggtgtttatggaacaacgtgcccaatccctcccgggaagaacttcacgtacattctccaagtcaaggatcaaatcggcagcttttactatttcccttccctcgccttccacaaggccgctggcggtttcggcggcatcagaatcctcagccgccctcgcattccggtcccctttcccgatcccgccggcgactacaccgtcctcatcggcgactggtacaagtctaaccacacgaccctgaaggctcatctggaccgtggtaagaagcttccgtttcctgatggaatcctcatcaatggtcgtgccaacgatacttcttttggcgtcgaacaaggaaaaacttacaggttgagaatttcaaatgtggggctgcaacactccctcaactttcgaattcaaggtcataaaatgaagcttgtagaagtggagggaacacataccctccaaacgacctactcctcgctcgatgttcatgttggtcagtcttactctgtgctcatcacagctgatcagccagctcaggactactacattgtcgtttccactcgcttcacttctcgggtgctcgctaccactggcattcttcgttacagtaactctgctggtcctgtcaaaggtccccctcctggcggtccgacgatacagatcgattggtccctcaaccaagcacgctctattaggaccaatcttacagccagtggaccaaggccaaacccacaagggtcgtatcactatggcctcataaacacaaccaaaaccatcatacttgccaattctgctggtcaagtcaaccgcaaacaaaggtatgcggttaacagcgtgtcatttgtccctgctgacactcccttgaaacttgctgacttcttcaaaatcggaggggtttttcgcgttggaagcatctctgataggcctaccggtggaggaatatacctcgacacatccgtgatgggtgtagactatagagcatttgtcgaaattattttccaaaacaatgaaaacattgtccaaagttggcacattgatggctactctttcttcgtggtcggcatggatggtggccaatggacgcagtctagcagaaaccaatacaatcttcgggacgccatcgctcgttgcacaactcaggtatacccttattcatggactgcaatttacgtggccctcgataatgtaggtatgtggaatgtgaggtcagagttttgggcaaggcagtatctcggacaacaattctacctccgtgtctatacaccctcgacttcgctcagggacgagtttcccattccaaagaatgctcttctttgtggcaaggcaacacttagtcccccacgaggtagtt

SEQ ID NO: 95 - DNA, 1927 bp, Euphorbia
acctttcattattcttctattcctctcttctctttaatattctctgctcctcttcagtcttctttcattttcttcatctttactgtgtgaaaagaggttgaagtggttttcaatttctccattgatagtatttttttttcttttgcctctaaaaaatgccgctgaaattagcgggaaaatgttcaatttgtacttttctctgcttagtcgcctcacttttcgccattgtcggcgctgaagatccctacagattcttcaactggaatgttacttatggtgatatttatcccctcggcgtccgtcaacggggtatacttatcaatggacagtttccaggccctgatattcattctgttaccaatgacaatcttattatcaatgtctacaacagcttagacgagccgtttctcctctcttggaatggagttcaacagaggagaaattcttatgtggatggtgtttacggaaccacatgcccaattcctccaggacaaaattacacatatattatgcaagtgaaggaccaaatagggagcttttactacttcccttctcttggatttcataaggctgctggtggttttggaggtattagaatccttagtcgcccacggattcctgtcccttttgcagatcctgatggtgattacaccattcttattggagattggtacaagtccaatcacacggttctaagagctcaattggatggtggtaagaagctgccattagctgatggaattctcatcaatggtcgggggcctaacggttattctcttactgttgaacaaggaaaaacttacaggctaagaatatcaaatgttgggttgcaaaattcactcaatttccggattcaaaatcataaaatgaaattagtagaagtagaggggacacatactctccagacaacctactcttcacttgatgttcatcttgggcaatcttactctgttcttttcacagctgaccagcctgggcaggattattacattgtggtttcttctcgtttcacctcaccggtcatcactactactggtgttcttcactatagcaactctgctggcccagtctctggcccaccccctggtggtcccaccattcaggttgattggtccctcaatcaggcccggtctattaggaccaatcttacagcaagtggaccaaggccaaatcctcaaggctcataccattatggaatgatcaacacaacaagaaccatcattttctcgagctctgcaggacaggttaatggcaagcagagatatgccgtcaatagcgtgtcctttatcccacaagatacccccctaaaacttgcagactacttcaakattcagggagttttcaaggagaacagcatagcatccaaaccttatggtggaggaatctacctcgttacatcagttttgacagttgattatagatcttatgtagagattgtttttgttaacgatgaggacattcttcagagctatcatctcgatggttacagcttctttgttgtgggaatggatggaggacaatggaccccagccagcaggaatggatacaatctccgagatggggttgcacgatgcaccatccaggtatatcccaagtcatggagtgctatttatattccactagacaatgtaggaatgtggaaccttagatcagaatactgggcccgccagtatcttggtcaacagttatatttaagggtatatacgtcatctacttcactaagagatgaataccctatccctaaaaatgctcttctttgtggcaaggctgccggtcgacacactcgacctctctaaaatatctatataataataccatacaaattaaaggctccagataagatgatttattgaagagtagggttttgtattattatgattcatttggctattttatattttgccataggataaatatgtatgatgat

SEQ ID NO: 96 - DNA, 2145 bp, Aristolochia
tccctccctttcttccccgcgtttgcttctccgagctgcttctccgtctccacttttcttcatctatctgtaccgcactctccctctctttctctttctctctctctctctctctctctctcgtcgatcaccgcctcttttttatacactgcaaagcacgaagcgaggagatcgttaaagaagaaaagaatccgcaggcgccaactgataaaagatgccgctcaacgtagcggccgctctttccttcatcttcttcgcggtggtcgtcacagccgaggatccgtacaggttcttcacttggaacgtcacttacggcgacatttacccgctcggtgtcaggcagcaggggatactgatcaatggccagttcccggggcctgatattcattccgtcaccaatgacaatctcatcatcaacgttttcaatagcttgcctgagcctttcctcatctcatggaacgggatccagcagagaagaaactcatgggaggatggagtttacgggacgacgtgcccgatcccgccagggagaaatttcacgtacatcctccaagtgaaggaccaaatcggaagcttgttctatttcccgtcgctggccttccacaaggccgccggaggctttggtgggatccgtatcctaagcaggccgaggatccctgtccccttccccgatcccgccggagatttcacagtcctcatcggcgactggtacaaggccaatcacacggacttgagggccaaactagaccgtggcaagaagcttcccctccccgacggcatcctcatcaatggtcgaggtccaaatggcgcatacttcacagtggaacaagggaaaacttatcggttccgtatatcgaatgtcgggttacagaattccctcaacatccgattccagaaccacaagatgaagctggttgaggttgagggcacccacaccgtccaaaacacctactcctctctggacgtccatgtgggccaatcctactccgttcttgtcacgatggaccagcccggtctggactactacatcgtggtgtccacccgtttcaccaacccagtcctcacgacaaccgggacccttcattacagcaactcggtcggccgagtctccggaccccctcccggcggacccaccatccagattgactggtcgctgaaccaggctcgttccgtcaggaccaacttgacagcaagtgggccgaggcctaatccccagggttcctaccactatggcttgatcaacaccactaggaccatcgtgctcgccaattccgcggggcttgtggacgggaagcaacggtacgccgtcaacagcgtctccttcgtccccgcggatactccgctgaaactcgccgatttcttcaagatcagcggcgtgttccgcgtcggaagcatctccgacagacccaccggcggcgggatatacaaagacacttcggtcctgggtgccgatttcagagcctacattgagattgtgtttcagaacgacgaagacattgtccagagctggcaccttgatggctattccttcttcgtagtcggaatggacggagggacatggaccactgccagtagaaactcctacaatctgagagatgcagtgagccgctgcacgacccaggtgtatcccaagtcgtggacggccatctatatggcactcgacaacgtagggatgtggaacctgaggtcggagttttgggcgcgacagtaccttgggcaacaattctacctgcgcgtctactcgcccgtggagtccataagagatgagtaccccatccccaggaacgcccgcctctgtggtagggcctccggacgtcacactcgccctctttaaacctttgtctcagggtggagtatgactagtcacatagaagagatgaccccagctcgaggtcccattctttattttagccctgtctgaagttgtctttttctctctcttttttaaatttgttgtgatcattaattactgggtataagctttatattgcgaattgtagaatgtttgtagctttcggccttcaatattatatacttggaataaaatttcttccatgcttcgcgagtctcactctctgagacagatttgttttctggggtggaatggctgaaagattaaggaaatcagaaccaatttgtatgcag

SEQ ID NO: 97 - DNA, 2113 bp, Quercus
tctcagttccacaaagttggaaaaaactagaaagagtctctgaatttgatttattgattgcgaaaatgccgctaaacatagcgggaagtgtacttagtgctgtgctatgcatcacagtttttctatttgcaactgttggggctgaagatccttacaggttcttcaactggaatgtcacttatggtgacatatacccacttggtgttcgccaacagggaatactcatcaatggtcaattcccaggtccagatattcattctgttaccaatgacaatctcattatcaatgtctttaacagcttaaacgagcctttccttctctcatggaatggaattcaaaataggaggaattcgtttgaggatggtgtaaatggaacaacatgcccaattcccccggggcagaatttcacctacattctccaagtgaaggatcagattggaagcttttactatttcccttctcttgcatttcacaaggctgctggtggttttggaggaatcaggattcttagtaggccaagaattcctgtcccatttccagaccctgctggtgattacaccgttcttattggagattggtacaaggctaatcacacggacttgaaagctcttctagatcgtggtaaaaagctgcattttcctgacggaatcctcatcaatggtcgcgggcccggtggtgctgcttatacagttgaacaaggaaaaacttacaggtttagaatatcaaatgttgggttacaacattcactcaacttccgcattcaaggccacaggttgacattggcagaagtagaaggaactcacacccttcagacttcttactcctcccttgatgttcatgttgggcagtcttactccgtcctcgtaacgatggatcagcccggacaagactactacattgtggtttccagtcgtttcaccactccaatcctcaccactactggagttcttcattacagtaattctgctggcccagtctcaggcccacctcctggtggacctaccatccaagttgattggtctctgaaccaggcccgctctattaggactaatcttacagcaagtggaccaaggccaaacccacaaggctcgtatcactatggtctcattaacacaaccaaaaccatcaggctacaaaattctgctggtcttgtcgacggcaagcaaagatatgcagttaacagtgtatcatatgtcgccgcagacactcccctaaagattgccgattacttccaaattcaaggagttttccgagttggaagtatatctagcaaccctactggtggtggaatctaccttgacacagcagtaatgggtgctgactacagagcattcattgagattgtgtttgaaaacactgaggatataattcagagttggcaccttgatggctactctttttgggtggttggtatggatggagggctgtggactacggctagtagaaatcagtacaatcttcgagacgcagtttcacgtgtcaccactcaggtgtatcccaagtcatggactgctatatatttggcacttgacaatgttggaatgtggaacttgagatctgagttttgggcacgacaatatcttggacaacaattctatttgcgagtttatactccatcaacttcaattagagatgaattcccaattccaaagaatgcactgctttgtggtagggcaaagggtcgacacacacgacctctctaagctatcaaacaataaaaggatccactgctgggtagggaaggcctgtctagcttagttgaatgaagagtaggttgttgcttctataatttattaatgggtgaatttaatataaagcaaatatataattagaactctaaatgaccttagctcaaggtcacattcttttctaaaatctactgtatctcgtttggtatcattcaagtttacataatagcattgctatttatattaagggaggtgattctctagtcgcctttcaggtttttttgtcaatttgttcttcctacttttgaatacaacaagaagcaagttttagtcccaaattttggggacggctatgattctcaagagattagttaagactggctatatgtatcattttctcattcttcttattttgaatatgatat

SEQ ID NO: 98 - DNA, 1976 bp, Actinidia deliciosa
cttttaaataccactcttaatttatcactaccaaagaaggtatagtctctctctctctcaagctgaaaatgccgctgaatttggcggccgtcttttgccttgcggtgtctctcttcgccgtcgttggggctgatgatccgtacaggtttttcaattggaatgtaacttatggagacatttatccactcggtgttcgccaacaggggattctaattaatggccaattcccaggtcctgatatatactctgtcaccaatgataatctcattatcaacgtttttaacagcttggacgagccttttcttctctcctggaatgggatccaacagaggagaaattcttaccaagacggagtttatgggacgacatgtcccattcctccggggaagaatttcacgtacattctccaagtaaaggaccaaatcgggagtttctactacttcccgtcccttgcattccacaaggctgccggtggcttcggaggtatcagaatcctaagtcgccctagaattcctgtccccttcccggatccggcaggtgactatacggttctgatcggagattggtacaaatctaaccacacggatttgaaggcgaagctggatcgaggcaagaagctgcctttggcggatgggatcctcattaatggccgtgggcctaatggtgcttctttcactgttgaacaaggaaagacttacaggctacgtatatcgaacgttgggctgcaaaattcactgaatttccgaattcagggccacaggatgacactggtggaggtggagggaacacactctgtccaaactagctactcgtggttggacgttcatccgggccagtcctactcggttctcgtcaaagctgatcagcccgctcaggattacttcgtggccgtgtccacccgtttcaccactgacgtcctcaccacctccgccattttccactacagcaactccgctggcccagtctctggcccaccccccggtggacccaccatccaaatcgacgagtccttaaaccaggcccgctctatcaggactaatcttacagcaagtggaccaaggcccaatccacagggctcataccactatggtctcataaacaccaccaaaaccatcaggcttgccaactctgcaggcctcatcaatggaaagcaaaggtatgcagtaaacagtgtatcatttgtgccagcggacacccctctaaagcttgcagacttcttcactattggaggagttttccgcgttgggagtatatccgataaccctaccggtggagggttgtaccttgacacgtcagttttgggcgtagactacagagcattcatcgaaatcgtgtttgaaaacaaagagaacatcgtccaaagttggcacctcgatggttactctttctttgtagtgggaatggatggagggttgtggtcgtcggctagtagaagccaatataatcttcgagatgcaatttcacgctccaccgttcaggtatatcccaagtcatggactgctatttatgtggcacttgacaatgtgggaatgtggaatctgagatcggagttttgggcacgacaataccttgggcagcagctctacttgcgcgtttatacagcatccacttcgcttagggatgaattccccattccgaagaatgcacttctatgtggcagagccagtggccggcacacgcgacccctctaatgcctccctctaatgccttacaatttgctacggaaagatttctgcctaatgaattggattcatttgagaccagagaccattttcatgtcctcttttttttccttgtttgaatttattcttaggtgctgcattattagcccagtacaatacaagggatatgtatcagtagaacatcaatgaccttaactcgaggtcatattctttggtttttagttgaagattgtaccctagttactactctatgtaagtttctttatgattaattaagaaattatgggtcttcga

SEQ ID NO: 99 - DNA, 2079 bp, Eucalyptus
tcaagcaaggtcacacacgttcacattcactcccactttttactcagccaaactccagacccgcaagcgcaacttcctcctccttcccagaataaatacacgaggcgacgctgacataggtcgtcactctctagcctagagcgagagataaagctctagctctgttcctctctttctccgtcactgtctgtggcgagaaaacgacgctgaagatggcgggaggtgcgatctgcgcttcgttggcggttgctctgttcttcgccattgtcggggctgaaaacccgtacaggttctttgactggaacgtgacgtacggcgacatataccccctcggcgttcgtcagcagggcatactcatcaatggccagtttccaggtcccgatattcactcagtcaccaatgacaacctcatcatcaacgtcttcaacagcttggacgtgcctttcctcatctcctggagtggaatccaacagaggaggaactcctacgaagatggggtgtatggtacgacttgccccataccacccggtagaaacttcacgtacatcttccaagtaaaggaccagatagggagcttcttctacttcccatcccttaagttccacaaggcggccggtgggtttggtgggatccggatccttagccgacctctaattcccgtcccgttcgcagaaccggccggtgattacactgttcttattggagactggtacaaggccaatcacacgactctcattgccacacttgaccgaggtaagaaactaaagtaccctgatgggatcctcattaatggtcggggaccaaatggcatctctttcgacgtgcaacaaggaaaaacttacaggcttagaatatcaaacgtgggactgatgaattcgctcaacttccgcattcaaggccacaaaatgctgttggtagaggtggaggggacgcacgtgatgcaaactcacttctcctcactggatgttcatgtgggccaatcttattcggtcctagtcacagcagatcaacctgctcaagactattacattgtggtttcgactcgcttttcctctcaaatcctcaccacaactggcattcttcgttacagcaactctgctggcccagtctctggccctcctccgggcggacccaccatccaaatcgattggtccctgaaccaggcccgtgccatcaggactaatcttacagcgagcggaccaaggcctaacccccaaggctcatatcattatggtctcatcacccccaccaggacaatcagactgtcgagttctgctggtcaagttaatgggaaacaacgatatgctgttaacagcgtctcctttatcccagcagacactcctcttaagctggcagactacttcaacattggtggagtttttcgggtaaatagcatatctgatagacccactggcggaggtatataccttgacaccgcagttttgggtgtcgactacagagccttcgttgagatagtgttcgaaaacaacgagaacatagtccagagttggcatcttgatggatacagtttctttgttgtgggcatggatggagggcaatggacaactgccagtcgaaatcaatacaatctccgcgatgccgttttccggagcaccactcaggtttacccctattcatggacggccatctatgtggcactagataacgtgggaatgtggaacttgaggaccgaattttgggcgcgacattacctcggccagcagctctatttacgagtctacaccacgtcgacttcgctgcgagacgaattccccattccgaagaacgcgcttctatgcggtcgagcgcaaggacgacacacgagacccttctaaagatttcaagcctataaaaagtttgaggagccagtgttgcagaaagtctctgacgctcaagttgaatggtctttagagtaaaggtgtctttgatttattcaaggttgttcttgaatgctttggctagggctattttgtgatttcaagacgttgaaacgacctcagctcgaggtcgcattctttccttgttcaagattcttatggcgataatatatttatatcgatagatcgagattcttcgatg

SEQ ID NO: 100 - DNA, 1888 bp, Amaranthus
atagcaatgcagccgttgttatacttgagcattgcttcattgttagtatcctttgttgttgctgatgatccttacagattctttaactggaatgtcacttatggtgatatttaccctttgggtgttcgccaacagggaattttgataaatgggcagtttccaggaccagatatccactcagttactaatgataatcttatcatcaatgtttttaacagtcttgatgttcctttccttctttcatggaatggaattcagaataggagaaattcttttgaagatggtgtatatggaacaacgtgccccattcccccaggaaagaacttcacttacattctccaagtcaaagatcaaattggaagcttctattactttccttctctcggattccaaaaggctgctggtggtttcggaggcatcaggatccttagcaggccgaggattcctgttccttttccagatcctgccggtgactacactgttctcatcggagattggtacaaggctaaccacactgatttgcaagcaacccttgatgccggacacaagcttcctcctccagacggaatcctaatcaatggtcgtggaagtggtgccacaatcaatgtagaacaagggaagacttacaggcttaggatctccaatgttgggctacagaactctctcaacttccgtattcaaggccacaagatgaaggtggtggaagtcgaggggacccacaccctccaaactaccttttcttcacttgatgtccatgtaggacagtcctactcggtgctcataacagccgatcaaccccctagggactactacgttgtagcttcatcgcgtttcaccaatcctgtactcactacaaccggattcctccgttattccaactctgggggctcagtccaaggcccaatccctggcggtcccacaatccagattgactggtccctcaatcaggctcgtgctatcaggactaatcttaccgcaagtgggccaaggcccaatccacaaggatcttaccactatggtatgatcaacacaaccagaactatcagactgcagaattctgctggacaagtgaatggaaagcagaggtatgccgttaacagtgtgtcattcatccctgctgatactcccctgaagctcgcagattactttaagatcggaggagtttttagtgttggaagcatccccagcaaccccactggttccgggatctaccttgctacttctgtgatgggtgctgactaccgagctttcatcgagattgtcttcgagaatactgaggatatcattcagagctggcatttggatggttacagcttctttgttgtaggaatggatggaggaacgtggtcagaagccagcagaaaccagtacaatctccgtgatgcagtttttcgttgtaccacacaggtgtatccgaattcatggactgcaatctatttggctctggacaatgtaggtatgtggaacttgaggtcagaattctgggcacgccaatacttaggacaacagttctacctacgagtgtacacaccatcgacatccctaagggacgagtatccgattcccaagaacgctctgacctgtggaagagcagcaggcagacgcacaaggccgatagtataatcaactagctagctatcttgctagtatatcaagagagtttgataagttattctgtaatattgttagtatggatgagaaatcgagaatagagcaaagagataagcaaatcttctgctttaatttgctcattagattcttttgttgtgctatattagcactagctttagtacccaaatgagggttgtattattagtacttacgtatatttgcattgcacgacctcttctcaaggtcgcattctttcaattttaataatattgttgtt

SEQ ID NO: 101 - DNA, 1733 bp, Cucumis sativus
atcgccatttctccctcttcattcgtcactcttcactcttcacaatgccctcctctctcctcttcctcttcatttctttcttcttcgccattgtccgagctgaggatccttaccgcttcttcgactggaatgtaacttacggcaccatttaccccctcggcctcccccagcagggcattttgattaatggccaatttcctggccccgatattcactctgttaccaacgacaatatcattatcaatgttttcaatagcttggatgagccttttctcctctcctggaatgggattcaacagagaaggaactcgtatgaagatggtgtgtacggaacaacttgccccattcctccagggaagaacttcacttacattcttcaaatgaaagatcagatcggaagtttctattacttcccttctcttggcttccataaggccgccggtgggtttggtggaatcagaattcttagccgtcctcggattcctgttccgttcccggatcctgccggggattatacagtccttatcggtgactggtaccaagctaatcatacgacgttgagggcccaattagacaatggctcaatgcttcctctccccgatggaatcctcatcaatggtcgtggacccaatagaactgcctcaatcaacgtggaacaaggaaaaacttacaggctgaggatttcaaacgtggggcttcaaagttctctgaacttccgaattcaaggccacagaatgaaggtggtggaagttgaaggaacccataccctccaaacggaattctcttcccttgacattcacgtaggccaatcttattccgtccttgtcactgcggatcagcccgctcaggacttttacattgtggtttcttctcgctttactactcccatcctctccaccaccgctattctccgttatgccaactccgccggctccgtccaaggcccgcctcctggtggcccaactatccaaatcgattggtcccttaatcaagctcgagccatcagaaccaatcttacagccagtgggccacggccgaacccacaagggtcgtatcactatggtatgataaccacgaccagaaccattgtagtggcgaactcagccggaattgtggacggaaagcaaagatacgccgtgaacagcgtgtcatttattccggcagacactccgctgaaggtggcagacttcttcaaaataggaggagttttccgggtgggaagcatttccgactggccaaacggtggaggaatctatcaagacacctctgttatgggcgccgattacagagcttttgtcgaaatcgtttttcagaacaacgaagacctcattcagagctggcatcttgatggctactccttcttcgttgttggtatggatggagggcaatggacatcgaatagcagaaaccaatacaatctacgagacgcaattgcacggtgtactgttcaggtgtatccaaagtcatggagtgcgatatatgtggcgctagacaacgttggaatgtggaatataaggacagaattttgggcaaggcaatacttaggacaacaattttacttgagagtttacactccatcaacgtcattacgagatgagtatccaattccaaagaatgctcttctttgtggaagagccaccggcagaagaaccaggccactctaatttccccatttatcatcatatcatttacataatcttcttcttccagctcgtaaagaaaaaaagaaaaaa

SEQ ID NO: 102 - DNA, 2110 bp, Lactuca sativa
ttttttaatctaatatttttccctctcaaaaccccttccatcagtcggcagacacaactcatcctctctctctatctgtaccgcactttaaattttcctaccctctccccatctccctacactttactccctctcctcccctccatctttcccaccgatcagaatcatgccgcgaagcttcgcgctttgcattgccgtcggagctgctctcctcgccatcgccggcgccgaagatccgtacaggttcttcaactggaatgttacgtacggcgatatttatcctctcggagtccgtcaacaggggattttgatcaatggacagtttcctggacctgatattcactctgttacaaatgacaatctcattatcaatgtcttcaacagcttaactgagccttttcttgtctcatggaatggagttcaacaaagaaggaattcttatgaagatggggtatttggcaccacgtgtccaattccaccgggtaaaaacttcacatatatccttcaagtgaaggatcaaattggaagtttttactattttccttctttagcatttcacaaagctgccggcggttttggaggtatccggattttaagccggcctagaattccggttccttttgatgaaccggccggagattatacagttcttatcggagattggtacaaagctaaccacactaccttgaaaacagttctagacggaggtcacaagataccattccccgatggcattctcatcaacggacgtggcccaggtggcgcctctttcgctgtcgaacaaggaaaaacatacagattacgaatctcaaatgtgggactacaaaactccctcaacttccgaatccaaaaccacaaaatgaaattagtagaagtagaaggaacacacacagtccaacaaacctactcttccctagacgtccactgtggtcaatcctattccgtactcatcactgcagatcaacccggtcaagactactacattgtcgtctcctcccgcttcaccaccccaattcttacaaccacgggcgtcctccactacgccaactccgccggacaaccctccggcccaatccctggcgggcccacaatccaagtcgactggtccttaaaccaagcccgatccatcagaaccaatctcaccgctagcggaccccgccccaacccacaaggctcataccactacggtatgataaacaccagccgcaccattgttcttcaaagctccgccggacaagttggtggaaaacaaagatatggaatcaacagtgtctcgtttaaaccatctgatgacactccgcttaaactcgcggattatttcaacatcggaggtgttttccgtgtcggaagcatctctgatagacccactggcggcggactttatacagacacgtcggttatgggagctgattacagagcttttgttgagattgtatttgaaaacccttccgatatcgttctcagttatcacatcgatgggtatcagttcttcgttgtcggaatggatggaggagaatggacacaagcaagcagggcgggttacaacttgcgagacggagttgcacggagtacgatccaggtgtacccaaaatcatggtcggcgctttatgttggacttgacaacgtgggaatgtggaatgtgaggacggaattttgggcaagacaatacctcggagaacagttttacttacgtgtgtacacaaattcagggtcgattagagatgaatttccgattccaaagaatgcgcgggtgtgtgggaaggccacgggtcgccatacacggcctctttgagaaggtatgaggatttgagtttagagatgtgttttttttccttattctagaattaaatttattttgggttgtgtttatttaattctttcttgtggtgctatgttagcactacttgaaaaattagtttatcggcttcttctgtattagtataactgtttatgaccttaactcaaggtcgcaattcttttttgttttttttatatgagtgtgttgaaagaaagaattctatattattgtaataagagaaatggttgcaagaaaattgtgattcatgtttataaccttatcattttattttagtttggaaagtttctttcc

SEQ ID NO: 103 - DNA, 1819 bp, Brassica rapa
tcgtgttttccattctctttactgtcacggcagaagatccgtacagattctttaactggaacgtcacatacggtgacatctacccactcggcgtccgccaacagggtattctgatcgacgggaagtttcccggaccggacattcactccgttactaatgacaatctcgtcatcaacatcttcaataacctcgacgaacctttcctcctttcatggaatggggtccagcagaggaggaactcgtacgtggacggagtgtacggaacgacatgcccaataccgccggggaagaactacacttacatgcttcaggtgaaggatcagattggaagtttctactactttccttctcttgctttccacaaagccgccggtggttttggtggaatccgtatcctcagccgtcctaggatccccgtccctttcctgaccccgccggagattacactgttctcatcggagactggtacaaatccaatcacacggatttgaaggcaaagcttgatagtggtaggaagcttcctttaccagatggtatcctcatcaatggccgtggaactggtgccactctcaatgttgaacaaggtaagacgtacaggctgagaatatccaacgtagggttacaacactccctcaacttccgcattcaaaaccacaagatgaaagtagtcgaagtcgaagggactcacactcttcagactactttctcctctctcgatgttcacgttggtcagtcttactcggtccttgtgactgctgaccagcctgcacatgactattacgtggtggtctcttctcggttcacctctactgtcctcaccaccactggtgttctccgctacagcggctcttccggtggtgtctctggtcctatacctggtggaccaaccatacaaatcgactggtccttgaaccaggcccgagccatcaggactaaccttacagcgagtggaccaaggcctaacccacaaggatcataccactacggtatgataaacaccacaagaaccatcagacttgctagctctgctggtcaggtcaacgggaagcaacgatacgcggtcaacagcgtatcgtttaagcccgcagacactcctttgaaactagcggactacttcaagattgatggtgtttacagagttggaagcgtgcagagccaacccaccggtggtggaatatacctcgacacatctgttttgcaagcagattacagaacctttgtggagatcgttttcgaaaacccggagaatatagttcagacctggcatcttgatggatactctttttgggttgttggaatggacggtgggaaatggagtcctgacagtaggaacgagtataatcttcgggatgcattggctcgctgcaccgttcaggtgtacccgagttcatggacggccatatacatagcattggacaacgtagggatgggaacctaagatccgaattttgggcaaggcagtacttaggacaacagctctatttacgtgtctacacaacctccacttctctcagagatgaattcccaatccccaagaacgctcttctatgcggwagagctagcggtcgtagcaccagaccgctttgagatgtggagagataagagagatggtcaaccaaaccagctgattcattctatggaagagtaatggtcatatwagtatatcagtttgtaatgatctcagctcgaggtctcaatttttattctttttaaaataatctctagagtgaaactttattcgatatatagttctgttgtaagccgtattgacgtagtgttacagtttactatggtatgaatcttcatttaacaattaaaa

SEQ ID NO: 104 - DNA, 2255 bp, Populus
ggctcgccattcacaccacatgctctgtaccgcacttaaatattgcgccatccctcgtcatttacagcctacttccccagaaactaaccccactccctcctccttaaagtcttcctctctttcacactcttctttccatattcagctcgactccgaaaacaggcagacgaaagaagtcttaataacaccttgtcctttggctccaaaatgccgctcaacttagcgggaaaaactgcagtactctgcacatttttgtgtgtctcagtttctattatttccagtgttaaagctgaagatccttacaggttcttcgactggaatgttacttatggtttcatctaccctcttggtgttcgtcaacagggtattctcatcaatggacaattcccaggacctgacattcactctgtgactaatgacaaccttattatcaatgtctataacagcttagatgagcctttcctcctctcttggaatggaattcaacagaggagaaactcatttgaggatggtgtcattgggaccacgtgcccgattcctccgggaaagaactttacatatattctccaggtcaaggatcagataggaagtttctactacttcccatctcttggattccacaaggctgctggtggttttggaggaatcagaatcctcagtcggcctcgaatccccgttcctttcgatgatcctgctggtgactacaccattcttattggagattggtacctgtccaaccacacggacttgaaggctgtattggacgggggcaggaagctaccattccctgatggaatcctcatcaatggtcgtggacgcaatggctattatcttactgtggaacaaggaaaaacttacaggttgagaatatcaaatgttgggttgcaaaattcccttaacttcaggatccaaaaccacaaaatgaagttggtcgaagtggaaggaacgcacactctccaaactacctactcgtctctcgacgttcatgttggccagtcttattctgttctatttactgctgaccaacctggccaagactattatattgtggttacttcacggttcacctctacagttctcaacaccactggtattctacattatagcaactctgctggtgcagtctctggcccattccctggtggaccaaccatcgaagttgactggtcactaaaccaggctcgctctatcaggactaatcttactgcaagtggaccaaggccaaatccacaaggctcataccactatggaatgatcaacactaccagaactatcatagtggcaaattcggctggtcaagtcaatggcaatcagagatatggagtcaatagcgtgtcctttatcgcaccagacactcccatgaagattgcagactacttcaaaattcagggagttttcaaggagaacggcataaccgacagaccttatggtggagggttgtacctggacacagcagttttgaccgttccttatagagcatatgtggaaattgtattccaaaacgatgaggacattttgcagagctggcatcttgatgggtacagtttctttgttgtcggcatggatggtggacagtggacaacagctagcagggaccagtacaatcttcgcgacgcagttgctagatgcactactcaggtgtatcccaaagcatggactgctatatatattccactcgacaatgtggggatgtggaacttgaggacagaattttgggcacgtcaatatcttggacaacaattttacttgcgagtttatactgattcaacttcactcagagacgaattccctattccaaagaatgcacttctttgtggtagggcaagtggtcgacgcacccgacctctgtaagctagtgcatcaccgaaggagccaccaattcagccgggaagtatgcctagtttttgaggataagaagtagagccttgcatctcatctttgcatgtgggtgctttacttaggctaagtattgaatgagaagattgtacgagtagaattcctaatgatctcagctcgaggtcacattcttttccattgatgattgtattttcttctatattaattaagtttttatacattatttatagtcatataaagccagctaattctcgaagctggcttgggtaattaatgtttgtatcatgcagtatatcagttcacttataatagtgtttgatctcttctctaatccctttatgttttgatgattttcttcgtttcttttaaatgcacaggaagtttgtgaagcattatta

SEQ ID NO: 105 - DNA, 2093 bp, Glycine max
ggggagagaccaaagagtgtgttgtgttgtgttggtaattaagaaaagagcaaaaatgccgctcaagttggcgggagtagccactgtcggttcccttcttctatgtgttgctatttctctctttcacatcgctggggccgaagatccctaccgcttcttcaactggaatattacttatggtgatatttaccctcttggtgttcgccaaacgggaatattgatcaacgggcaattcccaggtccagatattcattctgttaccaacgacaacctcatcatcaatgtcttcaacagtttagatgagccttttctcctctcctggaatgggatccagcagagaaggaactcgttcgaagatggtgtttttggaacaacatgccccattccagcagggaagaatttcacttacatccttcaagtcaaagatcaaattgggaccttttactacttcccatcccttgcattccacaaagccgctggcggttttggaggcattagaatccttagcaggccaagaattccagtcccattccctgatccagctggtgattacactgtcctcattggagattggtacaagtccaaccacacgactttgaaagcccgtcttgataggggcaagaagctgccttttcccgatggaatccttatcaatggtcgcggacctaatggagtgtctttcaacgttgaacaaggaaagacttataggcttagaatatcaaacgtggggctgcaacactcccttaactttagaatccagaaccacaaaatgaagctggtagaagtggaaggaacgcacacccttcagaccatgtactcctctcttgacgttcatgtagggcaatcttattcggtgctggtaactgcagaccaacctgctcaagactattacattgtggtttccacacgattctcctacaaggtcctcaccaccactggagtgcttcgctatagcaactccgcaggcccagtatcaggcccaccccctggtggacctacaatccaaattgattggtctttgaaccaggcccgctcaattcggacaaaccttacagcaagtggaccgaggccaaacccgcaaggatcgtaccattacggtatgataaacacgacgaagacgatcatactggcgagttccgctggtcaagtaaatgggaaacaaagatacgcaattaacagcgtgtcttatgttgtcccagacacccctcttaagctcgccgattacttcaaaatctccggtgttttccgccccggaagcatatctgacagacccactggcggcggcatttaccttgacacatctgtgttacaagctgactacagaaattttgtcgagattgtcttccaaaacaacgagaacatcgttcagagctaccatcttgatggctactctttctttgtcgttggtatggatgggggacaatggacaactgctagcaggaaccagtacaatctccgagatgcagttgcacgttgcaccacacaggtataccccttttcatggactgctatttatattgcccttgacaatgtgggaatgtggaacttgaggtctgagttttgggcacgacaataccttgggcaacagttatatttgcgcgtttatacaaacaatacaaacctcaatcagagacgagttccctgttccaaagaatgcaattctttgtggtagggcaagtgggagacacacgcgacccctttgagttagcaaggggtccacgcttgaggaggcattctagttttagaatacgaaaagtagttctaattttatagttgagtgctttcgtttatttattttatgctatgctccaatgggatgatgagtatgtatgattttatccctaaatgaccccagctcgaggtcacattaattctttcccagagaaagatagagagtgtgtgagagagagaatatatattatattccctttgtattatctcggattttactagtattgttatcaagaagggtgaatctgatcgcgaaagttggcgtttggaacctggctaagcagggtctgtgattcatttaattgttgtagctgtgcagaactttttaatttcaattgctatatgcctacgtagtttttaca

SEQ ID NO: 106 - DNA, 1866 bp, Eucalyptus
agagagagagagagagagagagagagaaatcgagcagaggactgtttttcgtagctttggctttgagtgaaaagagaggatgaggcagggactggagggtgcgggcgccctcttcctgtgcgcgtgcgtcgcttttctcgccattgcaggagccgaggacccctacaggttcttcaactggaatgtcacttacggcgacatttacccgctcggcgttcgccagcagggcatactcatcaatggacaattcccgggtcccgacatctactccgtcaccaacgacaaccttatcatcaacgtcatcaacagcctgaacgagcctttcctcctctcatggaatggaatccagcagaggaggaactcctttgaggatggagtctatggaaccacctgcccaatccctccaggcaagaacttcacctacatccttcaagtcaaggaccagatcggaagcttctattacttcccctccctcgcattccacaaggctgccggcgggttcgggggcatcaggatcctcagccggccactgataccggtcccattcccgccccctgctggcgattacaccatcctcatcggagattggtacaaggccaatcacacggatttgagggccattcttgacaatggtaaggtgctgccattccctgacggtatactcatcaatggccgtggaagcggagcttctttcactgtggaacaaggaaagacctacaggcttaggatatctaacgtggggttgatgaattccctcaacttccgcatccaaggccacaaaatggtgctcgccgaggtagagggtacacatacggttcaaaacacttacgagtcgctcgacgtgcacgtgggccaatcgctgtcagtcctcgtaacagctgaccagccaggaaaagactattacatcgtggtctcctctcgcttcaccacacaagttttgaccacaacaggcgtcctccattacagcaactctgccggccccgtctcaggtcctgttcctggtggtccgacaacccagatcgactggtccttgaaccaggcacgctctatccggacgaatcttacggcgagtggaccgaggccgaatccgcaaggctcataccactatggcatgatcaacacgacgagaaccatcagacttgccaattctgctggtcctgtcaatgggaaacagagatacgcggtcaacagcgtgtccttcatcccagcggatactcctctaaagctcgccgactacttcaagatcgatggagtttttcgtgtcgggagcatctctgacaaccctacaggcagcgggatatacctcgacacgtcggtgatgagagttgactacagagcctatatcgagatcgtcttcgaaaacagtgaggacaccatacaaagctggcacctcaatggctatgctttctttgtagtcgggatggatggagggcaatggacgccggccagcaggaaccagtacaatcttcgagatggcgtctctcgttgcaccattcaggtgtaccccaagtcctggtcggctatttacattccgctcgacaacgtcggaatgtggaacctgcgatcggagtcctgggcgagacagtacctcgggcagcaattctatatgcaagtctacaccacctcgacttcgctgagggacgagtacccgattcctaagaacgccattctgtgcggcagggcgagcgggcggcacacgcgacccctctgagcagcagcataacgacatcagcaacatagaaagatagtccatcattcttcggagtcattcattatggacctcagcttaaggtcgcattctttttcatgatggaatcatttgttcaaacttttttatgccaataaattaaatcatgggaaaattcc

SEQ ID NO: 107 - DNA, 1979 bp, Arabidopsis
cgtgccgactcttctctacataaactctacacttaaatctgtgtcttagagttagagagagaagaccacgccagaaatacctttcttgtttcaccggttttcatacacaaaaatggcgggcagtgcctcattcgccgccgcattattcatcggactctctcttctcttcgccgtcacggctgaagatccgtacagattctttgaatggaacataacttacggcgatatatacccactcggtgttcgccaacagggtattttgatcaacggggcgtttccgggaccggacattcattcggttactaatgacaatctcatcatcaacgtctacaatagcctcgacgaacctttccttctttcatggaatggaattcaacagaggaggaactctttcgttgatggagtgtatggaacgacatgcccaatcccgccggggaagaactacacttacattcttcagatgaaggatcagatcggaagtttttactacttcccttctctcggctttcacaaagccgccggtggatttggtggcattcgtatcctcagtcgtcctagaatcccggtccctttccctgatcccgccggagataccactgtccttatcggagactggtacaaagcaaaccacacggatttgagagcacagcttgataatggtaagaagcttcctttaccagacggcatcctcatcaatggtcgttcaagtggtgcaactcttaatgttgaacaaggtaagacatacaggtttagaatatccaatgtagggttacaagactctctcaacttccgcattcaagaccataagatgaaagtggtggaagtcgaaggaacacacactcttcagactactttctcttcactagatgttcatgttggacaatcttactcagtccttgtaaccgcggaccagactccacgggattattacgtggtcgtctcttctcggtttacctcaaatgtccttactaccacgggtattttccgatacagtaattctgctggtggtgtttctggacctattcctggtggacctaccattcaaatcgactggtccttgaaccaggctcgagccatcaggactaacctttcagcgagcggaccaaggccaaatccacaaggatcgtaccactacggtatgataaacactacaagaacgatcagacttgctagctctgctggtcaggttgatgggaagcaacgatacgctgtgaacagtgtctcattcaaacccgcagacactcctctgaaaatcgcggactacttcaagattgacggtgtttacagaagtggaagcatacagtaccaacccactggtggaggaatatacctcgacacatctgttatgcaagttgattacagaacctttgtggagattattttcgaaaattctgaggatattgtccagagctggcatcttgatggttactctttctgggttgttggaatggatggtggacagtggagtccagatagtaggaacgagtataacctacgcgatgcagtcgctcgctgcaccgttcaggtatacccaagctcatggacggctatattgatagcactcgacaacgtaggaatgtggaatctaagatccgagttctgggcgaggcaatacttaggacaacaattgtatttacgtgtgtacacaccctcaacttctctcagagatgaatatccaatccccaagaacgctcttctctgcgggagagccagtggtcgcagcaccagaccgctttgagctggtggttagatatagaaatgacggagagatggtcagccaaaccagctgacgcgttcttgaggcgggtttcttgttttatacacattcttcattttgctaatgaatgagaagagtttatgttaaaatcagtatatcagtttgtaacgatctcagctcgaggtctcattcttgattcttatattctttctttttctatggaacgaaacatttattcaatataattccacagtttcatcgt

SEQ ID NO: 108 - DNA, 2054 bp, Castanea
tctctcctttctctctctgtctctctcagcctttctcaacatagttccacatagttggaaaaaactagatagagtctctgaatttgatttattgattgagaaaatgccgctaaacttagcgggaggggtacttagtggtgctgtgctatgtgtcacagtttttctatttgcaactgttggggctgaagatccttacaggttcttcaactggaatgtcacttatggtgacatatacccacttggtgttcgccaacagggaatactcatcaatggtcaattcccaggtccagatattcattctgttaccaatgacaatctcattatcaatgtctttaacagcttagacgagcctttccttctctcatggaacggaattcaaaatagaaggaattcgtttgaggatggtgtaaatggaacaacatgcccaatacccccggggcagaatttcacatacattctccaagtgaaagatcagattggaagcttttactattacccttctcttgcatttcacaaggctgctggtggttttggaggaatcaggattcttagtaggccaagaattcctgtcccatttccagatcccgctggtgattacaccgttcttattggagattggtacaaggctaatcacacggacttaaaagatattctagatcgtggcaaaaagctgcattttcctgatggaatccttatcaatggtcgcgggcccggtggtgcttattatacggttgaacaaggaaaaacttacaggtttagaatatcaaatgttgggttacaacattctctcaacttccgcattcaaggccacaggttgacattggtagaagtagaaggaactcacacccttcagacttcttactcctcccttgatgttcatgttgggcagtcttactccgtcctcgtgacaatggatcagcccggacaagactactacattgtggtttccagtcgtttctccactccgatcctcaccaccaccggtgttcttcattacagtaattctgctggcgcagtatcaggcccacctcctggtggacctaccatccaagttgattggtctctgaaccaggcccgctcaattaggactaatcttacagcaagtggaccaaggccaaacccacaaggctcatatcactatggtctcatcaacacaaccaaaaccatcaggctacaaaattctgctggtcttgtcagcggcaagcaaagatatgcagttaacagtgtatcatatgtcgccgcagacactcccctaaagattgccgattacttccaaattcaaggagtttttcgagttggaagtatatctagcaaccctactggtggtggaatctaccttgacacagcagtaatgggtgctgactacagagcattcattgagattgtgtttgaaaacactgaggatataattcagagttggcaccttaatggctactctttttgggtggttggtatggatggagggctgtggactacggctagtagaaatcagtacaatcttcgagatgcagtttcacgtgtcaccactcaggtgtatcccaagtcatggactgctatatatttggcacttgacaatgttggaatgtggaacttgagaactgagttttgggcacgacaatatcttggacaacaattctatttgcgagtttatactccaacaacttcaattagagatgaattcccaattccaaagaatgcactgctttgtgggagggcaaagggccgacacacacgacctctctaagctatcaaacaataaaaggatccactgttgggtagggaaggcctatctagcttggttggatgaggagtaggttgttgcttctataatttattaatgggtgaatttaatagaatacaaatatataattagaactctaaatgaccttagctcaaggtcacattcttttctaaaatctactctatatcgtttgttatcattcaagtttacataatagcactgctatttatattaagggaggtgattctcttgtcgcctttcaagttttttgtcaatttgttcttcctacttttgaatacaacaagaagcaagt

SEQ ID NO: 109 - DNA, 1881 bp, Nicotiana tabacum
atatagcaaatttcagtgtaacgaaaaagaaaagaagaaatggtgccgctaaaactcgcaatagcggcatttttagtggtaggattagttgtgaatacagtagcagaagatccttatagattcttcgagtggaatgttacttatggcactatttatcctcttggagttcctcaacagggaattttgatcaatggccaatttcctggacctgatatttactctgttactaatgacaatctcattatcaacgttttcaacagcttggatgagccttttcttctttcctggaatggaatacaaaacagaagaaactcatttgaagacggagtatatggtacaacatgcccaataccaccaggaaaaaacttcacatacattctacaaatgaaagatcaaatagggagttattactatttcccttctcttgcatttcacaaagctgctggtggtttcggaggaattaaaattctcagcaggcctagaattcccgttcctttcccggaccctgcagacgattacactgtcctcattggagattggtacaagaaaaaccacacggcgttgaaagcaattcttgatggaggaaagaagttaccttttcctgatggcattcttatcaatggacgtggacctaatggtgtttctttcacagttgagcaagggaaaacttatagactgaggatatccaatgttggattacaaaattcgttgaatttccgtattgagggacacaagatgaaattagttgaagtagagggaacacacacattgcaaactacctattcctcacttgatgttcatgttggccaaacctactctgtcctcattacagctgatcaagaagctaaagatcactacatagtcgtttcatcgcgtttcacatctccggtcctcactaccaccggtgtacttcattatagtaactctaacacccccgtctccggtcctcctcctggtggtcctaccatccaaatcgactggtcccttaaccaggctcgatccatcaggacaaacttgtcggcaagtggaccaaggccaaatccacaaggttcataccattatggtatgatcaacacaacccgaaccatcagacttgctagttctgctggtcaagtgaatggcaaacagagatatgcagtcaacagcgtgtcgtttgtgccacttgatactcctctcaagcttcttgactacttcaaagttggtggattccgcgttggaagcatatctgatgctccaagtggtggaggaattttcctagacacgtctgttctaggcgctgattacaggcaattcattgagattgtattcgagaacaatgaggatatcgttcaaagctggcatcttaatggctactctttctgggttgtagggatggatggagggcagtggactcaagctagtagaaacggatacaatcttcgtgatgcagttgcacgttgcacaactcaggtgtatcctaagtcatggactgcaatatatattgcattggacaatgtaggaatgtggaacctaaggactgaattttgggcacgacaatacctcggacaacaattatacatgagagtttacactacatcaacttctttgagagacgaatatccaattccaaggaacgctcgtctctgtggcaaagtggctggccggcacacacgaccactttaagcaaagtttgcaattctaatagagaggaatttatttatacagtccttattatttctgagttttaaagtatatcttattactactactacggccatttgtgtaccrctagctgctaatttgaatgaccttaactcaaggtctcattctttcttccacggaactttgtatttggttctttcctcattgttttagttgyattaaaatgaagtgttttttttc

SEQ ID NO: 110 - DNA, 2014 bp, Helianthus annuus
cagacacactctgtaccgcacttttaaaagttccaaaccctccttcatcccccaccccaccacacactttcctaatttatccactcttcactttcaactttccactcaccggaataacaataacaataacaatgccgcgaaatgtggcggttttaatcgccgttggagccgttctcgttgccattgctggagctgaagatccgtacaggttcttcacctggaatgtcacctatggcgatatttatcctctcggagtccgtcaacaggggattttgatcaatggacagtttcctggacctgatattcactctgttacaaatgataatctcattatcaatgtgttcaacagcttacccgagccgtttttaatctcatggaatggaattcaacaaagaaggaattcgttcgaagacggtgtttatggcacaacatgtcccattccacccggtaaaaacttcacgtacattctccaagtgaaagatcagatcggaagcttttactacttcccatcattagcgttccacaaagccgctggtggttttggaggtatcaggatcctaagtcgtcctagaatccccgtcccttttgatgaacccgccggagattttactgttcttatcggagattggtacaaagctaaccacacgatcttgagaagagttctagatgcaggtcacagaatacctttccctgctggaattctcattaatgggcgtggaccaggcggtgcttctttcactgttgaacaaggaaaaacttataggctaagaatatcaaacgtgggattacaaaactcgctcaactttcgcattcaaaaccacaagatgaaactagtcgaggtcgaaggaacacatacggtccaacaaacatattcttcgttagatgttcacttaggacaatcttactccgtgctattcacagccgaccaacccggtcaagactattatattgttgtgtcctccaggttcaccacccctatcctcacaacaaccggcgttcttcactactccaactctgccggacaagtatccggcccaatccctggcgggcccaccatccaagtcgattggtcccttaaccaggcccggtccatcagaaccaatcttacagcaagcgggcctaggccaaacccgcaaggttcgtaccattatggtatgatcaacacgagccgaaccatcatcctccagagttcttcgggtcaagttaatggcatgcaacgatacgggatcaacagtgtctctttcaagcctgctgacactcccctcaagcttgctgattactttaacattggaggcgtttttcgtgttggaagcatatctgatagaccaactggtggcggtctttatgaagatacgtcggttatgggggctgatttcagagcttatgttgaaattgtcttcgagaacccatccaatattgttctcagttatcacattgatggctaccagttcttcgttgtcggaatggatggcggacaatggactcaagctagcaggaacggttacaaccttcgagacggtgttgcacgcagcacaatccaggtttacccgaaatcatggtcagcaatttacgtggcactcgataacgtgggaatgtggaacgtgaggacggaatactgggcccgacaatacctcggtgaacaattctacctacgtgtttacacaaactcggggtccatcagagacgaattcccaatcccgaagaatgcacgactgtgcgggagggcagccgggcgccacacacggcctctctgatagcacttgaaggtatgagtctaggagacatgttgtcacgtttagtataattaaattcattttggtttgtgtaatttattcttgtggtgctatataagcactacctgaaaaattagtgttcactttagaactgtttatgacctcacctcaaggtcacaattctttttattttcagtatctatataagtgtgctttttgttgttatgattattgtaataaaccgttacaagatatatatatgactcatgtctgttgcttca

SEQ ID NO: 111 - DNA, 2029 bp, Arabidopsis lyrata
gggccaagtttatgaacctccactcgctctctccctcaacgcacttaaatttacataactaagtgtgtgtctattcatatcactcactctctctctcttcctcactctcacattctccctctctttattttttctctctcaccacaagaaacgccgtagttcattaaaaatgatgacggtgggcagatccggaggcaccgtcgtcctattgttctgcctatcattcttcgcggcggtaaccgccgagagtccataccgattctttgactggaatgtaacatatggcgacatttatccactcggtgttcgtcagcagggaatattgattaatgggaaatttccgggaccggacattcacagtgtgacaaacgacaatctcatcattaacgtacacaacagcttagacgagcctttcttaatctcatggaacggaatacaaaacagaagaaattcttatgttgatggaatgtacggaaccacgtgtccaattccaccgagaagcaactacacatacattttgcaagtgaaagaccaaattggaagtttctattacttcccatctcttgcttttcacaaggcagctggtggattcggaggtatcagaatccttagtcgtcctggaattccagttccattcgctgaccctgcaggagattatactgtcctcattggagattggtataaatctaatcacacggatttgaagtctcgtcttgacagaggaaggaagttacctccgcctgatggtattcttatcaatggccgaagcaacggtgctaccttaaacgttgaacaaggaaaaacataccgattgaggatatcaaacgttggattacaagattctctaaacttcagaatccaaaaccacagaatgaagcttgtggaagtcgaagggacgcacacacttcaaaccatgttttcctcactggacgttcacgttgggcagtcttactccgttctgattactgctgaccaatctcctcgtgcctactacgtggttgtctcgtctcggttcacggataaaatcataacatccactggcgttcttcgctacagtggctcgtccaccccagcttctggtcctattcctggtggtcccacaattcaggttgattggtccttgaaccaagcacgtgccatcagaaccaatttgacagctagtggaccaagacctaacccgcaaggctcataccattatggtcttataccgctcattaggactattgttttcggtagttcagccggacagataaatgggaaacaaagatatggtgtcaatagtgtgtcatttgtgccagctgatacccctctaaaactggctgacttcttcaagattagtggtgtctataagatcaacagcatctcggacaaacccacatatggaggtttatacctcgacacatccgttttgcaagtcgactatcgaacctttatcgagattgtattcgagaaccaagaagatatcgtccaaagttatcatctcaatggttactccttttgggttgtcgggatggatggtggacagtggaagacaggaagcagaaatggttataatttacgcgatgcagtttcacgttccacagtccaagtgtacccaaaatcatggacagccatttacattgcattagacaacgtaggaatgtggaacttaagatcagagttttgggcaagacagtacttgggacaacaactttatttacgtgtcttcacgtcatcaacgtctttgagagatgagtaccctatcccgaagaattcgcgtttgtgcggccgggcaagaggacgacatactaggcctttgtaaggaagatatacaattacttgaaagtcgtcatatccatacacgtttaagttatatatatgttattcttgcgaagacttgcaaggttacaatgcgagagaggatgtagtaataatctagtttgaagtgatctcagctcgaggtctccatttttatgtaattcgaatttgaagttccagcatttctttatatgcttttattattcatgttcttttaattttctatcctttt

SEQ ID NO: 112 - DNA, 2072 bp, Arabidopsis
ggggccaagtctatgaactccactcgtctctccctcgacgcacttaaatttacataactaagtgtgtgtctattcatatcactcactctctctcttcctcacacttacattctccctctatttttttttctctctctccacaagaaacgccgtcgttcattaaaaatgatggcggtgggcagatccggaggcaccatcctattgttctgcctatcattcttcgccgcggtaaccgcggagagtccataccgattctttgactggaatgtaacatacggcgacatttacccactcggtgttcgtcagcagggaatattgattaatgggcaatttccgggaccagacattcacagtgtgacaaacgacaatctcatcattaacgtacacaacagcttagacgagcctttcttaatctcatggaacggagtacaaaacagaagaaattcttatgttgatggaatgtacggaaccacgtgtccaattccaccgagaagcaactacacatacattttgcaagtgaaagaccaaattggaagtttctattacttcccatctcttgcctttcacaaggcagctggtggattcggaggtatcagaatccttagccgtcctggaattccagttccatttgctgaccctgcaggagattacactgtcctcattggagattggtacaaatttaatcacacggatttgaagtctcgtcttgatagaggaaggaagttaccttcgcctgatggtattcttatcaatggccgaagtaacggtgctaccttaaacgttgaacaaggaaaaacataccgattgaggatatcaaacgttggattacaagattctctgaacttccgaatccaaaaccacagaatgaagcttgtggaagtcgaagggacgcacacacttcaaaccatgttttcctctcttgacgttcacgttggccagtcttactccgttctaattactgctgaccaatctcctcgtgactactacgtggttgtttcgtctcgattcacggataaaatcataaccaccaccggggttcttcgctacagtggctcgtctacccctgcttctggtcctattcctggcggtcccactattcaggttgattggtccttgaaccaagcacgtgccatcagaaccaatttgacagctagtggaccaagaccaaacccgcaaggctcataccattatggtcttataccgctcattaggacaattgtgttcggtagttcagccggacagataaacgggaaacaaagatatggtgtcaatagtgtgtcatttgtgccagctgatacccctctaaaactggctgacttcttcaagattagcggtgtctataagatcaacagcatctcagacaaacccacatatggaggtttataccttgacacctcagttttgcaagtcgactatcgaacctttatcgagattgtattcgagaaccaagaagatatcgtccaaagttatcatctcaatggttactccttttgggtggtcgggatggatggtggacagtggaagacaggaagcagaaatggttataatttacgcgatgcagtttcacgttccacagtccaagtgtacccaaaatcatggacagccatatacattgcattagacaacgttggaatgtggaacttaagatcagaattttgggcaagacagtacttgggacaacaactttacttacgtgtcttcacgtcatctacgtctttgagagatgagtaccctatcccgaagaattcgcgtttgtgcggccgggcaagaggacgacatactaggcctttgtaaggaagatatacgagcttacgtgaaattcgtcatatccatacacgtttaagtatttcttgggaagacttgcaaggttacaaacaatgagagaggatatatgtagtaacaatctagtttgacgtgatctcagctcgaggtctaaatttttatgtaattcgaatttgaagttccagtttttctttatatgcttttgtcattcatgttcttttaattttctttcctttttctacgaagttataaacttataatattaattgaattttactcatttggatcat

SEQ ID NO: 113 - DNA, 776 bp, Arabidopsis lyrata
aaaaaaaagttagaggtccaatggcggagaaagaagaggatgtgaaacttctaggtttttgggcaagcccttttagtcgtagagtcgagatggctctcaagctcaaaggagtgccttacgagtacttggagcaagatatagtaaacaagagccctttgcttctccaactaaatccagtttacaagaaggttccagttcttgtccacaaaggtaaagtattatccgagtcacatgtggtcctcgaatacatcgaccaaatatggaaaaacaatccaattcttcctcaagatccttacgagaaagccatggctctattctgggccaagttcgttgatgaacaggttggaccagtagcctttaggtatgtggcaaaagcagagaagggaatagaggttgcaatcaaggaggctcaagaactctttatgtttcttgagaaggaagtcactggaaaagatttcttcggtggcgaaacaattggattcttggacttggtcgcaggaagtatgatcccgttttgtcttgctcgaggttgggaaggtatgggaattgatatgataccagaggaaaagtttccagaactaaaccgatggatcaagaatttgaaagaaattgagatcgtgcgagaatgtattcctcctagagagaaacaaattgagcacatgaagaaagttgtagaaagaatcaaaccggcctaagagacaacaatcatacttttcaatcgacagatcttaactatatgtttgtataatctcgttttataaaagttgtatgaacaa

SEQ ID NO: 114 - DNA, 903 bp, Raphanus sativus
gatcacgagaacaaaattagataaactaatcaaagaataaggaagcaagtgagatccaatggcggagagagaagaggatgtgaagcttctaggcttttgggcaagccctttcagtcgcagagtcgaaatggctctcaaacttaaaggcgtgccttatgagtacttggagcaagacttgatgaacaagagccctttgcttcttgagctaaatccggtttacaagaaggttccggttcttgtccacaaaggtaaaatattgctcgagtcacagctgatcctcgaatacatcgaccaaacatggacaaacaatccaattcttcctcgagatccttacgaaaaagctatggctttattctgggccaaggttgttgatgaacaggtcaaaataaggttcagcactctggtgaaagcagagaagggagtagaggttgcaattgaggaggctcgagaactccttacgtttcttgagaaggaagtcaccggaaaatatttattcggtggcaagacaattggatttttggacatggtcgctggaagcatgattccgttttgtttggctcggggttgggaaggtatgggaattgatatgattccagaggaaaaatttcctgaacttaacagatggatcaagaatctgcaagaaattgagatcgtgacggaatgcattcctcatagagagaaacaaatcgagcatatgaagaaagttgcagtgcgtatcaaatcggcataagagattaattatcatagtttttggtctggagttgttaactatattttccgtagaactgtttgaacaatctattaaataaagatcaatgatacctgcatctgtaatgctaatattttgtatgaaatctagatatctctttactatttttaatgaggagaatgtttgataatgca

SEQ ID NO: 115 - DNA, 801 bp, Raphanus sativus
ggraaaaacaaaattgtcaagaggagttagaagtctagagaaaaagcaagcgagatccaatggcgaataaagaaaaggatgtgaagcttctaggtttttgggcaagccctttcagtcgtagggtcgagatggctctcaaactcaaaggcgtgtcgtacgagtacttggagcaagatattgtcgacaagagcgctttgcttcttgaactaaacccggttttcaaaaaggttccggttcttgttcacaatggtaaaatattagccgagtcacatctgatccttgaatacatcgaccaaacatggaagagcaatcctattcttcctcaagatccttacgagaaagccatggctcgtttctgggccaagttcgttgatgaacaggtcggaccagtatgtttcaagtctgtggtgaaagcagagaagggaatagagattgcaattgaagaggctcaagaacttattaccttcctcgagaaagaacttacagggaaagattttttcggcggcaagacaataggattcttagacttggtcgcaggaagtatgataccgttttgtctagctcggagttgggaaggtatggaaatagatatgattccagaagaaaagtttccagaacttaacagatggattaggaacttgaatgatatcgaagttgtgagtgaatgtattcctcacagggagaaacaaattgagcacatgatgaaagtagtagagcgaatcaaattggcataagagagacttgtatgtttgtatctccttttatctgaaagaacaatttactaaataagtaatttctaca

SEQ ID NO: 116 - DNA, 849 bp, Canola
ggtcaaaggagttagaagtctagagaaaagcaagtgagatccaatggcgactaaagaggaggatgtgaagcttctaggtttttgggcaagcccttttagtcgtagggtcgagatagctctcaaactcaaaggcgtgacatacgagtacttggagcaagatattttcaacaagagtgctttgcttcttgaactaaacccggttttcaagaaggttccggttcttgttcataaaggtaaaatattagccgagtcacatctgatccttgaatacatcgaccagacatggaagaacaatcctattcttcctcaagatccttacgagaaagccatggctcgtttctgggccaagttcgttgatgaacaggtcggaccagtatgtttcaagtctgtggtgaaagcagataagggaatagatgttgcaattgaagaggctcaagaacttattaccttcctcgagaaggaacttatcgggaaagattttttcggcggcaagacaatcggattcttagacatggtcgcaggaagtatgatcccgttttgcgtagctcgggcttgggaaggtatggaaatcgatatgataccagaagagaagtttccagaacttaaccgatggatcaagaacttgaatggtatcgaaattgtgagggaatgtattcctaatagagagaaacaaattgatcacatgatgaaggtcgcagagcgaatcaaattggcttaagcgaaacttatatgtttgtatctccttgttagaaaaaaatgtacgaataatctactaaataagcaatgtatgcatcggccgtgattttagaaaagcaatttaagccttcgtcttttatatgaaacaattag

SEQ ID NO: 117 - DNA, 877 bp, Brassica rapa
ataaactggcattggtttttaccaaaaggtctagagaaaaagcaagtgagatccaatggcgactaaagaagaggatgtgaagcttctaggtttttgggcaagcccttttagtcgtagggtcgagattgctctcaaattcaaaggcgtgtcatacgagtacttggagcaagatattttcaacaagagtgctttgcttcttgaactaaacccggttttcaagatggttccggttcttgttcataaaggtaaaatattagccgagtcacttctgatccttgaatacatcgaccagacatggaagaacaatcctattcttcctcaagatccttacgagaaagccatggctcgtttatgggccaagttcgttgatgaacaggtcggaccagtatgtttcaagtctgtggtgaaagcagataagggaatagatgttgcgattgaagaggctcaagaacttattaccttcctcgagaaggaacttagcgggaaagattttttcggcggcaagacaatcggattcttagacatggtcgcaggaagtatgataccgttttgtgtagctcgggcttgggaaggtatgggaatcgatatgattccagaggagaagtttccagaacttaaccgatggatcaagaacttgaatgatatcgaaattgtgagggaatgtattcctcaaagagagaaacaaattgagcacatgatgaaggttgcagagcgaatcaaattggcctaagacacatatctatttttgtatctcctgttatataaagttgtatgaataatcagaatctactaaataagtaatttatgcatccgccgtgatagtagaaaagcaatttaagtttttgggtatttttaggataaataattttttaaaatc

SEQ ID NO: 118 - DNA, 829 bp, Canola
aaaggagttagcagtctagagaaaaagcaagtgagatccaatggcgactaaagaagaggatgtgaagcttctaggtttttgggcaagcccttttagtcgtagggtcgagattgctctcaaattcaaaggcgtgtcatacgagtacttggagcaagatattttcaacaagagtgctttgcttcttgaactaaacccggttttcaagatggttccggttcttgttcataaaggtaaaatattagccgagtcacttctgatccttgaatacatcgaccagacatggaagaacaatcctattcttcctcaagatccttacgagaaagccatggctcgtttatgggccaagttcgttgatgaacaggtcggaccagtatgtttcaagtctgtggtgaaagcagataagggaatagatgttgcgattgaagaggctcaagaacttattaccttcctcgagaaggaacttagcgggaaagattttttcggcggcaagacaatcggattcttagacatggtcgcaggaagtatgataccgttttgtgtagctcgggcttgggaaggtatgggaatcgatatgattccagaggagaagtttccagaacttaaccgatggatcaagaacttgaatgatatcgaaattgtgagggaatgtattcctcaaagagagaaacaaattgagcacatgatgaaggttgcagagcgaatcaaattggcctaagacacatatctatttttgtatctcctgttatataaagttgtatgaataatcagaatctactaaataagtaatttatgcatccgccgtgatagtagaaaagcaatttaagttttt

SEQ ID NO: 119 - DNA, 450 bp, Arabidopsis lyrata
aaacccgtcaacacctcttctttaaggatctctttcccttcaaagaaaatatcacaaaaatggcaaacgtctccgccctgctcacgatagctcttctcctgtgctccacgctaatgtgcactgcccgccccgaaccggccatatccgtctctatcacgactgctgccgatccatgtaacatggagaagaaaatagaaggaaaattagatgacatggtagaagaaaactgtggttccgacgacgaagattgcttaatgaggaggactttggtcgctcatactgactacatctatacccagaagaagaagaagaatctttgaatttcactaatttatttctaacaaacttttgcttaaggttatgtaatttatgtcatctttaattagtatttgtcacaaacaacatcaagatatatagttatggttgtgattatttatatgtaatttggat

SEQ ID NO: 120 - DNA, 3376 bp, Medicago
caattgttgaacaaatggaagcctcttcttcttcttcttgcagatcaagttcaaccacaagtttatgcagctaccatgtgtttttgagttttcgaggagaagatacacgcaaaggattcactgatcatttatgtgctgcccttgaaagaaaagggataacaacttttagagatgacaaagaccttgagagagggcaagtcatttcagaaaagctaatcaatgcaattaaagattctatgtttgccatcactgtcctctcaccagactatgcttcctccacctggtgtttggatgaacttcaaatgatcatggaatgcagcaataagggtctagaagttttaccagtcttctatggtgtggatccatctgatgtaagacatcaaagaggatgctttgaggaatctttcagaaaacatctagagaaatttggtcaacacagtgacagggttgatagatggagagatgctttcacacaagttgccagttactctggatgggattccaagggccagcatgaggcattactagttgaaagcattgctcaacacatacatagaaagctggttcctaaattgtcatcttgtacagagaaccttgttgggattgagtcaaaggtggaggaagtgaacaagctcataggtatggggttgaatgacgttcgctttatcggcatatggggtatgggtggcataggcaagtcaactattgctagagcggtctatgaagcaatccgatgtgaatttcaacttacttgctttctagaaaatgttagagagatatctgagacaaatggtttagttcacttacaaagacaacttctttctcatatgagtataagtaggaatgattttcataatttgtatgatggcaaaaaaacaatacaaaactctttccgtaggaaaaaggttctacttgttcttgatgatgtgaatgaattaaaccagttggagaatatggctgggaagcaagactggtttggtccgggaagtagagtaataatcacaacgagagataaacacttgttaatgacacatggagtacataaaacttatgaggtttggatgttattccaaaatgaagctcttaatctcttttgtttgaaagcctttaaaggagataaaccacaagaaggctatttggatttgtccaaagaagtggtggactatactggtggtcttccattggcacttgaggtgtttggttcctatctttatggaagaaatgttgatctttggcatagtgccattaaaaaaataagaagtgtgcctctacgtaaaatccaagataaactggaaataagttatgagagcttagatccaatggagaaggatgtatttcttgatattgcgtgtttcttcaagggaatgaagatagataaagtaatagatatattagaaaattgtggttatttccccaaaattataattcaagttttgattgacagatctttgataactctagatcgggtcaataataaattggggatgcatgatttgcttcaagaaatgggcaggaatattgtatttcaggaatctccaaatgatcctggcagatgtagcaggttatggtctaaagaggacatcgattctgtgttgacaaaaaataagggaactgaaaaaattagcagtgtagttctgaacttacttcaaccatatgaagcacgctggagcactgaagcattctcaaaaacaagtcagctaaaattgctcaacttaaatgaggtgcaacttccccttggcctcagctgccttccttgttcgctgaaagttcttcggtggagaggatgtcctcttaagactctagcgcaaacaaatcagctggatgaagttgttgacattaaattatctcatagcaaaatcgaaaaactttggcacggagtatattttatggaaaagctgaagtatctgaatttgaaattttccaagaacctaaagagattgccagatttttccggggttccaaatcttgaaaaattgattcttaaaggctgctcaatcctaactgaggttcatctatcccttgtacaccacaagaaagttgttgtagtgagtttaaaaaactgcaaaagtctaaaatcgcttcccgggaagttggagatgagttccctgaagaagttaattctgtcaggctgcagtgaatttaaattccttccagagtttggggaaaaaatggaaaatttatcaatccttgctttaaaaggaacagatataagaaaactgcccttatcacttggaagcctagttggacttactaatttgaacttaaaggactgcaaaagtcttgtttgccttccggataccattcatggattgaattccctcataattttgaacatttctggatgttcaagactttgtagattgccagatggattaaaggaaatacagtgtttgaaggaacttcatgccaatgatactgctattgatgaactaccttccttcattttctatctagataatcttaaagtattatcatttgctggttgccaagggccaccggcaatgtcaacgaactggtttcccttcaattggatgtttgggggtcaatcagcttccactggattcagattaccaacttctttcctgagcttacattctttgaaatatttaaacctaagttattgtaatctttctgaagaatcgatcccgaattattttcaccacctatcatctttgaagtctttggatctaactggtaacaattttgttatcataccaagcagcatttctaaactttcaagactgagatttctttgtctaaattggtgcgaacagcttcaattgttgccagagcttccatcaagaataatgcaattggatgcaagcaattgtgattcattggaaactcgtaaatttgatccaatagagagctttatgaagggacgctgtctacccgcgaccagatttgacatgcttatcccattcccaggggatgaaattccatcttggtgtgtttctcaaggatctgtttcctgggctaaagtacatatccctaataatttgccgcaagatgaatgggtaggatttgcattgtgtttccagctagtgagttataccttcccacctgaactgtgcaatcatgagattgattgttatttgttttcacctaatggtaagcagctgatcttgatcagcaccaggagattacctcctatggatccatgttatcctcacctttatattctctacttgtccattgaacaattccgcgacaagattctccaagatgattattgggatggcgttgaattttcattgaaatgttattgttgccattcattgcgaatattcagtagtggctgccgtttggtgtgcaaacaagttgttgaagtgtttcaagatcaaacagtcgtcagtccttgacaatagcatcattc

SEQ ID NO: 121 - DNA, 1158 bp, Arabidopsis lyrata
tacacattttatcccaaaaaaaaacaataaatacacatgcaggtctttgtaatgcatcaatacctcgttccctctcttctcagatggctcaaaaagtggaagcagcaggtggtaccggaggagcttcatgggatgatggtgtgcacgatggcgttagaaaggtgcatgtagggcaaggccaagatggtgtgtcgtctatcaaagtcgtgtatgcgaaggattctcaggatgttgaaggaggtgaatatggaaagaagacgttacttggattcgaaacgtttgaagttgatgcagacgactacattgtagcagtgaaagtgacctacgacaacgtatttggccaagactctgacattatcacatctataaccttcactacattcaaggggaaaacatctccaccctatggattggaaacggaaaagaagtttgtactcaaggacaaaaacggtggcaaacctgttgggttccatggacgtgctggcgaagctctacatgctcttggagcgtattttgctacaaccacaactcctgggactcctgccaagaaactgtctgcaattggtggggatgaaggaactgcatgggatgatggtgcttacgatggtgttaagaaggtgtacgtaggacaaggtcaagatgggatatcagccgttaagtttgagtacaacaaaggcgctgaggatattttaggaggtgaacatggaaagcgtactttactcggattcgaggagtttgagctagactatccaagtgaatacatcacggcagttgaaggcacctatgatagaatctttgggagtgatggcgtagtcataactatgcttaggttcaagactaataaacaaatgtctgccccctttggacttgaagctggcacagccttcgagctcaaagaggaaggccacaagatcattggcttccatggaaaagccagcgagttgcttcatcagtttggagtccatgtcatgccaatcaccaactgaccacattatgtgatctcttgaataagttgttatacctataatgatatattatctttatttatgtttaaatgtttttaagcgttcccttttgtgatgttggtctttatataatgtttacatgtgatagatttgaataaaagtggttgattccatgcatattaattgcacatta

SEQ ID NO: 122 - DNA, 1179 bp, Arabidopsis
ggatcactcgactctttctatctatctcttatcaggtaattcgaaagacatcaaaagcaagcaaaagatggctcaaaaggtggaagcacaaggaggtattggaggagatgtatgggatgatggtgctcacgacggcgttagaaaggtgcatgtagggcaaggccttgatggtgtttcgtttatcaatgtcgtgtacgagaatggttcacaggaagttgtaggaggtgaacatggaaagaagtcactaattggaatcgaaacgtttgaggttgatgcagacgactacatcgtagcagtgcaggtgacctatgacaaaatatttggctatgactccgacatcatcacatccataaccttctctacattcaagggaaaaacctcgccaccctacggattagataccgaaaataagtttgtactcaaggaaaagaacggtggcaaacttgttgggttccatggacgcgctggcgaaattctatatgctcttggagcgtattttactacaaccacaactcctttgactcctgccaagaaactaccggctgttggtggtgacgaaggaactgcctgggatgatggtgctttcgatggtgttaagaaagtgtatatagggcaagcccaagatggtatatcggccgtgaagtttgtgtacgataagggcgccgaggatattgtaggagatgaacatggaaatgatactctactcggatttgaagagttccaacttgactatccaagtgaatatattactgcagttgaaggcacatatgacaaaatatttggttttgagactgaagtcataaatatgcttaggttcaaaactaataagaaaacgtctcctccctttggaattgaagctggcacagccttcgaactcaaagaagaaggttgcaagatcgtcgggtttcatggaaaagtaagtgcggtgcttcatcagtttggagtccatatccttcctgtcaccaactgatcatcacatatatatatatatatatatgtctcttctataccaccaagtttgtcacgtgtgatatcttcattaagttttaagttttctaatttttcttgttctgtttatctatgttttaagtgtctttaagtatggtgttttgtgaagttgttatgcctgtaatattatatgtgattggctttaataaaagtgggtgattattatacata

SEQ ID NO: 123 - DNA, 1095 bp, Arabidopsis lyrata
ggatcactcgactctcttctataactatctcttatcaggtaattcgaaaaactgatcaaaagcaagcaaaagatggttcaaaaggtggaagcacaaggaggtatgggaggaaatgtatgggatgatggtgttcacgacggtgttagaaaggtgcatgtagggcaaggccaagatggtgtgtcgtttattaatgtcgtgtacgagaatggttcagaggaagttgtaggaggtgaacatggaaagaagtcacttattggaatcgaaacatttgaggttgatgcagacgactacatcgtagcagtgcaggtgacctacgacaaaatatttggctttgactctgaggtcattacatctatcaccttctctacattcaagggaaaaacctctccaccctttggcttagataccgaaaataagtttgtactcaaggaaaaaaatggtggcaaacttgttgggttccatggacgcgctggcgaaattctatatgctcttggagcatattttactacaaccacaactcctttgaatcctgccaagaaactaccagcagttggtggtgacgaaggaactgcatgggatgatggtgcttacgatggtgttaagaaagtgtatatagggcaagcccaagatggtatatcagcagtaaagtttgtgtacgacaagggcgctgcggatattgtaggagatgagcatggaaatgatactctactcggatttgaagagttccaacttgactatccaagtgaatacattacagcagttgaaggcacatatgataaaatctttggtagtgagactgaagtcataaatatgcttaggttcaagactaataagcaaacgtctcctccctttggaattgaagctggcacagccttcgaactcaaagaggaaggttccaagatcgtcgggttccatggaaaagtcagttcgctgcttcatcagtttggagtccatgtccttccagtcaccaactgatcatcacatcaaatttttcttgtttatttatatatgttttaagtgtctatgccgtattttgtgaagttgttatgtctttgatgttatatgtgattggctttaataaaggtgggtgattat

SEQ ID NO: 124 - DNA, 1127 bp, Raphanus sativus
ggataactcgactctctatctctctttgatcagtaattagaaggccttatcaaaagcaagcaaataatggctcaaaaggtggaagcacaaggaggcgtgggaggagatgtatgggatgatggtgtttatgacggcgttagaaaggtgcatgtaggacaaggccaagatggtgtatcgtttatcaatgccgtgtacgagaagggttctcaggaggttgaaggaggtgaacatggaaataagacactacttggattcgaaacgttcgaggttgatgcagacgactacatcatagcggtgcaggtaacctacgacaaaatatttggccatgagtccgacgtcatcacatctattaccttctatacatccaaagggaaagcctctccaccctatggattagagaccgacaaaaagtttgtactcaaggaaaaaaacggcggtaaacttcttgggttccatggacgcgcgggagaggttctgcatgctcttggtgcgtatttcgttacaaccacaactcctttgactcctgccaagaagctgccagcagttggtggtgatggaggaaccgcatgggatgatggtgcttacgatggtgttagaaagttgtttgttggacaagcacaagatggtatatcagtcgtcaagtttgtgtacgacaagggggctgaggaaattataggagatgaacatggaaatagtactttactcggattcgaagagtttgtacttgactatcctagtgagtacatcacgtcagttgaaggcacatatgataagatatttgggagtgactctgaggtcgttaccatgcttaggttcaagaccaataagcaaacgtctgctccctttggaattgaagctgggacacccttcgaactcaaagaggaaggctccaagatcgtcgggttccatggaaaagtcagtgagctgcttcatcagtttggagtccatgttcttccaatcacttattgatcatcacatgttttcctttcattcccttccattaagtttcctaccttttctgttctgtttgtttatgtttccagtgtgttattgtctcctttatgatgttgtcatgtgtttgatgctatatatctgtctgctttaataaaatggttgatttgaacaca

SEQ ID NO: 125 - DNA, 2075 bp, Arabidopsis lyrata
aaaatgggtcccactttttcccatttcccaacctccataaccatagttggagatttctctgtttcctatgctctctctctctcttactctcacagtgactattcgtcggagagcttcagatctaaaagagggaagataaaccctttggattcaatatcgatatcggaaatcttttgacttcacaagaatggcagtgacagaggttgaaaatcctcttcttggtgaaatcacttgtggcaccttactacagaagttgcaggaaatctgggatgaggttggggagagtgatgaggaacgagacaaattgcttcttcagattgaggaagagtgtcttaatgtttacaaaaagaaagttgagctggccgcaaaatctcgtgcagagcttcttcagactttgtcggatgccactgttgaactttccaatctcacaactgctctcggggaaaaaagctatattgacattccagataagacttcaggaacgatcaaggaacaactttctgcaatagcacctgcgcttgaacaactttggcaacagaaagaggaaagggtccgggcgttttccgatgtacaatcacagattcagaaaatatgtgaagagatcgctggtggattgaacaatggacctcatgtggttgatgagtctgacttgtctctgaagagattagatgacttccagagaaaacttcaagagctccagaaagagaagagtgataggttacagaaggtgctcgagtttgtgagcaccgtgcatgatctatgtgccgtccttggtttagatttcttaagcactgtcactgaagttcatccgagcttagatgaagcaaatggtgttcaaaccaagagtattagcaatgaaacacttgcgaggttggctaagactgtcttgactcttaaagaggataagatgcaaagacttaaaaagcttcaagagctagctactcagttaactgatctatggaatctcatggatactcctgatgaggaaagggagctttttgatcatgttacctgtaacatttcagcatcagttcatgaagtgactgcctctggtgctctcgcacttgatctgatcgaacaggctgaggtgaaagtggataggcttgaccaactgaaatctagcagaatgaaggaaattgcattcaaaaagcaatctgagcttgaggagatatatgctcgtgctcacatagaaataaaaccagaggttgttcgcgagaggatcatgtcgttgattgatgctggaaatactgaacctactgagctactggctgacatggatagccagatcgcaaaggccaaggaagaagccttcagtagaaaagaaattttggaccgagtcgagaaatggatgtcagcttgtgaggaagagagctggctcgaagactacaatcgagatcagaacaggtatagtgcaagccgaggtgcgcatttgaatctcaagagagctgagaaagctcggattctggtcagcaagattactgcaatggttgacacattggttgctaaaacccgggcatgggaagaggataacagtatgtcctttgagtatgatggtgttcctctgctcgccatgctagatgaatacactatgcttaggcaagaacgagaagatgagaagcggaggctgaaagaacagaagaagcagcaagaacagccacatacagatcaagactccgcctttgggtcaaaaccaagccctgcaagacccgttagtgccaagaaaacggtgggaacacgagccaacggaggagggctcaacgaaactcctattaggcgtttatcaatgaactcaagccagaacggaagcaagtcgaagagagacagtctgaacaagatagcttcaccttcgaaccttgtagccaacacaaaagaggatggtgcatctccagtctgtcgtgttgacccagtgatggcttcaccgtgagaattatcaaagaaagagagttgaaatgcttacttacacttttggtagttgctaatagtgctgtctaagaaacaaacacttgaaacaaagacattgagagtagaatgttacttagatgtttatgtctctgtattcagtgactcaattgttt

SEQ ID NO: 126 - DNA, 2177 bp, Arabidopsis lyrata
gattttatctcactctcaatagtgtgagttttgttatagagagagcttcagatctagaagaagaagcagagtttataaggacaaacccattttaaacccttagaaatccagtgtcaatctcggaaacctactgattttgcgacaatggcagtcacagatgctgaaagtcctcatcttggggaaattacttgtggtaccttacttcagaagttgcaggaaatctgggatgaagttggtgagagtgatgagcaacgagacaaactgcttcttcagatagagcaagagtgtcttgatgtttacaagagaaaagtcgagcaggctgcgaaatcccgagctgagcttcttcaaaccttgtcagatgctaatgctgaactttccagcctcacaacttctcttggagagaaaagcttagttggcattccggataagtcttcagggacgattaaagagcaacttgctgctatagcaccggctcttgaacaactgtggcaacagaaagaggagagagtccgagagttctctgatgtacaatcacaaattcagaagatatgtggagagattgctggaggtttgagcaatgaggttcctatagtcgatgagtctgatttgtcactgaagaaattagacgatttccagagccaactccaagagctccagaaagagaagagtgacaggctgcacaaggtgttagattttgtgagtactgttcatgatctatgtgccgttcttggtttggatttcttaagcaccgtcaccgaagttcatccgagcttagatgaagaaactggtgttcagtctaagagcattagcaatgagacactttcaaggttggctaaaaccgtcttgactcttaaagatgataagaagcaaagacttcaaaagcttcaagagctggctactcagctaattgacctgtggaatctgatggatactcctgatgaggaaagggagctttttgatcatgttacctgtaacatttcatcttcagtggatgaggtcactgtgccaggtgctcttgcacgtgatttgattgagcaggctgaggtggaagtgcataggcttgaccagctgaaagctagccggatgaaggaaattgcgttcaagaagcaatctgagcttgaagagatatatgctcgtgcccatgtagaaataaacccggaatctgctcgtgagagaatcatgtcgctgattgatactggaaacgttgagcctactgaattattggcagacatggatagccagatagcaaaggctaaagaagaagcgtttagtagaaaagatatattggaccgagtcgagaaatggatgtcagcttgtgaggaggagagctggctagaagactacaatcgggatcagaacaggtacagtgcaagcagaggcgcacacttgaatctcaagagagctgagaaagctcggattctggttagcaagattcctgccatggttgacacattggttgccaagacccgggcgtgggaagaggaacacagcatgtcctttgcctacgatggtgttcctctgctagcaatgctagacgagtatggtatgcttaggcaagaacgagaagaggagaaacggaggctgagggaacaaaagaaggttcaagaacagccacacatagagcaagactctgcctttagcaccaggccaagccctgctagaccggtcagtgctaagaaaacggtggggccacgagctaacaacggaggagccaatggaacaccaaaccggcgtttatctttgaatgcaaaccagaatggaagcaggtctactgcaaaagaagcagggagaagggagactctcaacaggccggctgctcccacaaactacgttgccatttcgaaagaggaagctgcttcatcaccggtttctggtgctgtagatcataaagttcctgcttcaccatgatgatttgaaaaaatgaaaaaagatctgtaattttcactgtttgagtttgttttaggaagaaaaggctctatgaaacacctgaaagaagacaaaagacatttgagagtagaatggtgtactagaatgtgtatgtgtgtgtgttttgttagtgttgttttgatagttggtacggtatcatctcgactcaaaaacaacctttttactagggtttatatgggccttgacatagaaagcccataagaacctatatcaagatctttgtccaagtt

SEQ ID NO: 127 - DNA, 2239 bp, Arabidopsis
aagcaaaaaagattttatctcactctcaatagtgttagtattgtcacagagaaagcttcagatctagaagaagaagcagagttcataaagagaaacccattttaaaccctagaaatcaagtgtcaatctcggaaaccttctgattccgcaacaatggcagttacagatactgaaagtcctcatcttggggaaattacttgtggtaccttacttgagaagttgcaggaaatctgggatgaagttggtgagagtgatgatgaacgagacaaactgcttcttcagatagagcaagagtgtcttgacgtttacaagagaaaagtcgagcaggctgcgaaatcccgagctgagcttcttcaaaccttgtcagatgctaatgctgaactttccagcctcacaatgtctcttggagacaaaagcttagttggcattccggataagtcttcaggaacgattaaagaacaacttgctgcaatagcaccggctcttgaacaactgtggcaacagaaagaggagagagtccgagagttctctgatgtacaatcacagattcagaagatatgtggagatattgctggaggtttgagcaatgaggttcctatagtcgatgagtctgatttgtcactgaagaaattagacgatttccagagccaactccaagagctccagaaagagaagagtgacaggctgcgcaaggtgttagagtttgtgagtactgttcatgatctatgtgctgttcttggtttggatttcttaagcaccgtcaccgaagttcatccgagcttagatgaagataccagtgtccagtctaagagcattagcaatgagactctttcaaggttggctaaaaccgtcttgactcttaaagatgataagaagcaaagacttcaaaagcttcaagagctggctactcagctaattgacctgtggaatctgatggatactcctgatgaggaaagagagctttttgatcatgttacctgtaacatttcatcttcagtcgatgaggtcactgtgccaggtgctcttgcacgtgatttgattgagcaggctgaggtggaagttgataggcttgaccagctgaaagctagccgaatgaaagaaattgcgttcaagaagcaatctgagcttgaagagatatatgctcgtgcccatgtagaagttaacccggaatctgctcgtgagagaatcatgtcgctgattgattctggaaacgttgagcctactgaattattggcagacatggatagccagatatcaaaggctaaggaagaagcatttagtagaaaagatatattggaccgagtcgagaaatggatgtcagcttgtgaggaagagagctggctagaagactacaatcgggatcagaacaggtacagcgcaagcagaggtgcacacttgaatctcaagagagctgagaaagctcggattctggttagcaagattcctgccatggttgacacattagttgccaagacccgggcttgggaagaagaacacagcatgtcctttgcctacgatggtgttcctctgctagctatgctagacgagtacggtatgcttaggcaagaacgagaagaggagaaacggaggctgagggaacaaaagaaggttcaagaacagccacacgtagagcaagaatctgcctttagcaccaggccaagccctgcaagaccggtcagtgctaagaaaacggtggggccacgagctaacaacggaggagccaatggaacacataaccggcgtttatctttgaatgcaaaccagaatggaagcaggtctactgcaaaagaagcagggagaagggagactctcaacaggccggctgctcctacaaactacgttgccatttcgaaagaggaagctgcttcatctccagtttctggtgctgcagatcatcaagttccagcttcaccatgatgaataaaaaaatgaaaaagatgtgtaattttcagtgtttgagttggtttaggaagaaaaggctctatgaaacacctgaaagaagacaaaaagacatttgagagtagaatggtgtactagaatgtgtatgtgtgtgtgtgttttgttaatgttattttgatagttgtatcatcttcgctaaaaaaaacaacctttttctagggcttatatgggccttgagatagagagcccataaagacctttcattatctttgtccaagtttaatagcgtcctcaagtaggcaaggcatgatctttcagttctatgacatattgacatgta

SEQ ID NO: 128 - DNA, 594 bp, Arabidopsis lyrata
atgataaaatcagtgactcttcgctcgtttcatctccctattgagtttaacgacaccaaattcgccgcaccgtcgtttccccccgcgagatccttcccggtggttcgttgttcaagcaccagagacgtccctaagcttgaactcttcagccgcggaaaattcgaccggattcttcaagatccgcctctaatcgaaaaagccgaaaccgaactctcagattactgttcgacgcttgaaggtgatgattcttacagttgctggagagcttactttgaactcaaagatctcgaaagagagaagcctaaggttgaagttgagaatttgattttgcaaacaggcggtgtgaaatcgctaatcgggtgtttacatggagttgcgtcaatggagaaagacaacaaaaccaagaatggtttaaatagagagaaaggaatgaagttgcatattcatattcctgatggtttaccaaaatctgaacaagaattggaggaagaagagaaatcgaaaatgccggattccgctttcactaggttgcttagaactaaaggaactatccctgcttggttctctcacgctcctgatcacgaaaccgactga

SEQ ID NO: 129 - DNA, 832 bp, Thellungiella
ggacttcattctcctcttctggataatttcaaagtttctaaaaaaactcagcttcttgctacttcctacaagatgataaagtcggtgactcttcgttcgtttcctctccctatagagttcaacggcaagtctaagttcctcgagccgtcgacgtcttatttcccggcgagatccttcacagtggttcggtgttcaagcacgagagacgtccctaagcttgagctcttcagccgcggaaaattcgatcggattcttcaagatccgccattaattgaaaaagccgagtccgaactctcagattactgttcgacgcttgaaggtgatgattcttacagctgctggaaagcatactttgagctcaaagacctcgaaaaagagaagccaaaggtggaagttgagaatctgatcttgcaaaccggcggtttaaaatcgttaatcgggtgtttacacggggttgctttgatagagaaagacaagaaaaccaagaatggtttagaatcaacagaggaatcaaattcaaagaaaggaagcatgaaactacatattcatatccctgatggtttaccaaaatctcaagaagagttagaggaagaagagaaatcgttaatgcccgattctgctttcacaagattgcttagaacaatgggaaccatccctgcttggttctctcacgttcctgaccatgaaacagactaaataatctttagaaagttgtttccttatcacggttttgctttcatgtaaatatagcaaaagtttggtttcttgattttgcttagaacatacagtcactgtaatctctctttcatattcccaagaaaatgtggttgtc

SEQ ID NO: 130 - DNA, 900 bp, Brassica oleracea
gccttatccacttcactcttctgcacaactcgaactttaaaaaccaacccttctttcttgctacttgcaaataatactatctttctttcagtgaagatgataaagtctgttactcttcgtccgtttcctctccctatagagtttcacggcaagcctcagttcgtcgaaccgtcgaagtcttgttttgcggtggtcaggtgttcaagcacgagagacgttcctaagcttgagctctttagccgcggaaaattcgaccgtgtacttcaagatccgccattaatagaaaagaccgagaacgaactctccgattactgttctacactcgaaggtgatgcttcttacagctgctggagagcttactttgaactcaaagaccttgagaaagagaagccaaaggtggaagttgagaatctaatcttgcaaacaggcggtgtgaaatcgctaatcgggtgcttacatggacttgcttcgatggagaaggaaagcaaaaccaagaatggttcagaggttacagaggaatcagattcagataagatgaaactacacgttcacgttcctgatggtttaccaaaatctcaagaagaattagaagaagaagagaaatcaagaatgccagattctgctttcacaagattgcttagagccaaaggaaccatccctgcttggttctctcacgctccggaccacgaaacagactgaaagaatccatctcacacagttttacttctatgtacatatagcaaaaagtggtttcttgatattttgctttataacatataattattataataccttttcataatacctataaaatatggtttgtcaatgtgtgatgatcttgaatggttttgatgataaagttgtttcgaagccgtgtgcytwatttagtacctgattttg

SEQ ID NO: 131 - DNA, 1058 bp, Canola
ggtgtataatcataatttaagataaggttgtataaatataaaatatcctttgattggtcccacacccaaaatatcttaaacatgggattttttttttatagataactcttcggatactttttcataattcaatttgctttttccttttctctataaaaaaaagtatccgaagccttatccacttcactcttctgcacaactcgaactttaaaaaccaacccttctttcttgctacttgcaaataatactatctttctttcagtgaagatgataaagtctgttactcttcgtccgtttcctctccctatagagtttcacggcaagcctcagttcgtcgaaccgtcgaagtcttgttttgcggtggtcaggtgttcaagcacgagagacgttcctaagcttgagctctttagccgcggaaaattcgaccgtgtacttcaagatccgccattaatagaaaagaccgagaacgaactctccgattactgttctacactcgaaggtgatgcttcttacagctgctggagagcttactttgaactcaaagaccttgagaaagagaagccaaaggtggaagttgagaatctaatcttgcaaacaggcggtgtgaaatcgctaatcgggtgcttacatggacttgcttcgatggagaaggaaagcaaaaccaagaatggttcagaggttacagaggaatcagattcagataagatgaaactacacgttcacgttcctgatggtttaccaaaatctcaagaagaattagaagaagaagagaaatcaagaatgccagattctgctttcacaagattgcttagagccaaaggaaccatccctgcttggttctctcacgctccggaccacgaaacagactgaaagaatccatctcacacagttttacttctatgtacatatagcaaaaagtggtttcttgatattttgctttataacatataattattataataccttttcataatacctataaaatatggtttgtcaatgtgtgatgatcttgaatggttttgatgataaagttgtttcgaagccgtgtgcttaattta

SEQ ID NO: 132 - DNA, 837 bp, Canola
cttgctacttgctaataagtaatgataatatctttctttcagtgaagatgataaagtctgttactcttcgtccgttccctctccctatagagtttcacggcaagcctcagttcgtcgaaccgtcgaagtcttgttttgcggtggtcaggtgttcaagcacgagagacgttcctaagcttgagctcttcagccgcggaaaattcgaccgtgtacttcaagatccgccattaatagaaaaagccgagaccgaactctcagattactgttctacactcgaaggtgatgcttcttacagctgctggagagcttactttgaactcaaagaccttgagaaggagaagccaaaggtggaagttgagaatctaatcttgcaaacaggcggtttgaaatcgctaatcgggtgtttacatggacttgcttcgatgaagaaggaaagcaaaaccaagaatggtttagaggttacagaggaaacggattcagataagatgaaaccgcacgttcacgttcccgatggtttaccaaaatctcaagaagaattggaagaagaagagaaatcaagaatgccagattctgctttcacaagattgcttagagccaaaggaaccatccctgcttggttctctcacgctccggaccacgaaacagactgaaagaatccatctcacacagttttacttctatgtacatatagcaacaagtggtttcttgatactttgctttataacatataattattataataccttttcataatacctataaaatatggtttgtcaatgtgtgatgatcttgaatggtctgataataaagttgttttgaagccgtgtgcttatttta

SEQ ID NO: 133 - DNA, 866 bp, Brassica rapa
cccacgcgtccgcgaactttaaaaaccaacccttctttcttgctacttgctgataataatatctttctttcagtgaagatgataaagtctgttactcttcgtccgtttcctctccctatagagtttcacggcaagcctcagttcgtcgaaccgtcgaagtcttgttttgcggtggtcaggtgttcaagcacgagagacgttcctaagcttgagctcttcagccgcggaaaattcgaccgtgtacttcaagatccgccattaatagaaaaggccgagaccgaactctcagattactgttctacactcgaaggtgatgcttcttacagctgctggagagcttactttgaactcaaagaccttgagaaggagaagccaaaggtggaagttgagaatctaatcttgcaaacaggcggtttgaaattgctaatcgggtgtttacatggacttgcttcgatgaagaaggaaagcaaaaccaagaatggtttagaggttacagaggaaacggattcagataagatgaaaccgcacgttcacgtccccgatggtttaccaaaatctcaagaagaattggaagaagaagagaaatcaagaatgccagattctgctttcacaagattgcttagagccaaaggaaccatccctgcttggttctctcacgctccggaccacgaaacagactgagagaatccatctcacagagttttacttctatgtacatatagcaacaagtggtttcttgatattttgctttataacatataattattataataccttttcataatacctataaaatatggtttgtcaatgtgtgatgatcttgaatggtttaatgataaagttgttttgaagccgtgtgcttattt

SEQ ID NO: 134 - DNA, 910 bp, Raphanus sativus
gaagcagtggtatcacattacggccggggactcttctgcataatctccaacttcaaaaaccaaccttctttcttgctacttgctaacaattatatctttcagtgaagatgataaagtctgttactcttcgaccgtttcctctccctatagagtttcacggcaagcctaagttcgtccaaacgtcgaagtcttgtttcccggtggtcaggtgttcaagcacgagagacgttcctaagcttgagctcttcagccgcggacagttcgaccgtgttcttcaagatcccccattaatagaaaaaaccgagaccgaactctcagattactgttgtaaactcgaaggtgatgactcatacagctgctggagagcttactttgaactcaaagaccttgagaaagagaagccaaaggtggaagttgagaacctaatcttgcaaacagacggtgtgaaatcgctaatcgggtgtttacatggaatcgcttcaatggagaaggaaagcaaaaccaagaatggtttagaggttagagaggaatcagattcagacaagatgaaactgcacgttcatgttcctgatggtttaccaaaatctcaacaagaattggaggaagaagagaaatcaagaatgccagattctgctttcacaagattgcttagagccaaaggaaccatccctgcttggttctctcaccctcctgaccacaaaacagactgaagaatccatctcacacagttttacttctatgtacatataactattgtaatatatctgtttttttaatatatcttcataatgcctataaaatatagctgtcaatgtgtgatgatcttgaatggttcgatgataaagttgtttccgagccgtgtgcttattttagtacttggttttggttacaaagatatttctattcttga

SEQ ID NO: 135 - protein, 331 aa, Arabidopsis lyrata
MARLKSFLLLLSLLCFVPLCLCDTSNGGKLCSGFYARSCPQAEEIVRSVVAKAVVRETRMAASLLRLHFHDCFVQGCDGSLLLDSSGRIVSEKNSNPNSRSARGFDVVDQIKAELEKQCPGTVSCADVLTLAARDSSVVTGGPSWVVPLGRRDSRSASLSGSNNNIPAPNNTFQTILSKFNRQGLDVTDLVALSGSHTIGFSRCTSFRQRLYNQSGNGRPDMTLEQSFAANLRQRCPRSGGDQILSVLDIISAAKFDNSYFKNLLENMGLLNSDQVLFSSNEKSRELVKKYAEDQGEFFEQFAESMIKMGNISPLTGSSGEIRKNCRKINS

SEQ ID NO: 136 - protein, 331 aa, Brassica rapa
MARLSSFLFVLSLLCVLPIYLCQQSYGGKLNPGYYAHSCPQAGEIVRSVVAQAVARETRMAASLMRLHFHDCFVQGCDGSLLLDSSGRIVSEKSSNPNSKSARGFEVVDQIKAQLEKQCPGTVSCADILTLAARDSSVLTGGPSWMVPLGRRDSRSASLSGSNNNIPAPNNTFQTILSKFNRQGLDVTDLVALSGSHTIGFSRCTSFRQRLYNQSGNGRPDMTLEQSFAANLRQRCPRSGGDQNLSVLDIVSAAKFDNSYFKNLIENMGLLNSDQVLFSSNDKSRDLVKKYAEDQEEFFEQFAESMIKMGNISPLTGSSGEIRKDCRKINS

SEQ ID NO: 137 - protein, 331 aa, Raphanus sativus
  misc_feature (178)..(178): Xaa can be any naturally occurring amino acid
  misc_feature (181)..(181): Xaa can be any naturally occurring amino acid
MARFTSFLLVLSLLCFLPLCLCHKTSGGKLSPYYYAHSCPQAGEIVRSVVAKAVARETRMAASLMRLHFHDCFVKGCDGSLLLDSSGRIVSEKNSNPNRKSARGFDVVDQIKAQLEKECPGTVSCADALTLAARDSSVLTGGPSWMVPLGRRDSRSASLSGSNNNIPAPNNTFQTILXKFXRQGLDITDLVALSGSHTIGFSRCTSFRQRLYNQSGNGRPDMTLEQSFAANLRQRCPRSGGDQNLSVLDKVSPANFDNSYFKNLVENMGLLSSDQVLFSSNDKSRELVKKYAEDQGEFFKQFAESMIKMGNISPLTGSSGEIRKNCRKINS

SEQ ID NO: 138 - protein, 338 aa, Arabidopsis
MARIGSFLIILYLIYALTLCICDDDESNYGGDKGNLFPGFYRSSCPRAEEIVRSVVAKAVARETRMAASLMRLHFHDCFVQGCDGSLLLDTSGSIVTEKNSNPNSRSARGFEVVDEIKAALENECPNTVSCADALTLAARDSSVLTGGPSWMVPLGRRDSTSASLSGSNNNIPAPNNTFNTIVTRFNNQGLDLTDVVALSGSHTIGFSRCTSFRQRLYNQSGNGSPDRTLEQSYAANLRQRCPRSGGDQNLSELDINSAGRFDNSYFKNLIENMGLLNSDEVLFSSNEQSRELVKKYAEDQEEFFEQFAESMIKMGNISPLTGSSGEIRKNCRKINNS

SEQ ID NO: 139 - protein, 339 aa, Arabidopsis lyrata
MARIGSFLIILYLTYALTLCICDDDESMYYGGNKGNLFPGFYRSSCPRAEEIVRSVVAKAVARETRMAASLMRLHFHDCFVQGCDGSLLLDTSGSIVTEKNSNPNSRSARGFEVVDEIKAALENECPNTVSCADALTLAARDSSILTGGPSWMVPLGRRDSRSASLSGSNNNIPAPNNTFNTIVSRFNNQGLDLTDVVALSGSHTIGFSRCTSFRQRLYNQFGNGSPDSTLEQSYAANLRQRCPRSGGDQNLSELDINSAGRFDNSYFKNLIEKMGLLNSDEVLFSSNEQSRELVKKYAEDQEEFFEQFAESMIKMGNISPLTGSSGEIRKNCRKINNS

SEQ ID NO: 140 - protein, 771 aa, Arabidopsis lyrata
MVKEISYGFLILSMVMFVSPVIAINGGGYPRCNCEYEGTSFWTTENILETQRVSDFLIAVAYFSIPIELLYFVSCSNVPFKWVLFEFIAFIVLCGMTHLLHGWTYSAHPFRLMMALTVFKMLTALVSCATAITLITLIPLLLKVKVREFMLKKKAHELGREVGLILIKKETGFHVRMLTQEIRKSLDRHTILYTTLVELSKTLGLQNCAVWMPNDGETEMNLTHELRGRVGYGGCSVSMEDLDVVRIRESDEVNVLSVESSIARASGGDVSEIGPVAAIRMPMLRVSDFNGEPSYAILVCVLPSGQPRDWTYQEIEIVKVVADQVTVALDHAAVLEESQLMREKLAERNRALQMAKRDALRASQARNAFQKTMSEGMRRPMHSILGLLSMIQDEKLSDEQKMIVDTMVKTGNVMSNLVGDSMDMSDGRFVTEMKPFSLHRTVHEAACIARCLCLCNGIRFLVDAEKSLPDNVVGDERRVFQVILHMVGSLVKPRKRQEGSSLMLKILKERGSLDRSDQRWAAWRSPASSADGDVYIRFEMNVENDDSSSQSFASVSSRDQEVGDVRFSGGYGLGQDLSFGVCKKVVQLIHGNISVVPGSDGSPETMSLLLRFRRRPSISVHGSSESPAPDHHAHPHSNSLLRGLQVLLVDTNDSNRAVTRKLLQKLGCDVTTVSSGFDCLSAVAPGSSSSSTSFQVVVLDLQMVEMDGYEVAMRIRSRSWPLIVATTVSLDEEMWDKCAQIGINGVVRKPVVLRAMESELRRVLLQADQLL

SEQ ID NO: 141 - protein, 775 aa, Brassica oleracea
MVREVASGLLILFSILIWVSPAAAGNGGGCNCEDEGVSFWSTENILETQRVSDFLIAVAYFSIPIELLYFVSCSNVPFKWVLFEFIAFIVLCGMTHLLHGWTYGPHPFKLMVALTVFKMLTALVSCATAITLITLIPLLLKVKVREFMLKKKAHELGREVGLIMIQKETGVHVRMLTQEIRKSLDRHTILYTTLVELSKTLALQNCAVWMENEGKSEMNLTHELRGSSGRSGYGYSVSMHDVDVVRVRESNDVNILSVDSLIARASGGDVSEIGPVAAIRMPMLRVSDFKGGTPELIQTCYAILVCVLPSGQPRDWSYQEIEIVKVVADQVAVALSHAAVLEESQMMRDKLADQNRALQIAKRDAMRASQARNVLQKAMSEGMRRPMHSILGLLSMIQDEKLSNEQKMIVDTMVKTGNVMSNLVGDAMDVSDGRFVTEMKPFSLHRTVREAACLARCLCLYNGFRFTVDAEMSLPDNVVGDERRVFQVILHMVGSLVKPRKCREGSLSSSVIFKVFKERGSLDRSDQRWAAWRSPTCSADGDVYIRFEMSVENDGSGSQSFASVSSRDQEVGEVRLSGYGLGQDLSFDVCKKVVQLIQGNISVVPGSDGSPETMSLLLRFRRRPSISVHGTGEAPAPDHHLHPHSDSLLRGLQVLLVDTNDSNRAVTRKLLEKLGCIVTAVSSGFDCLTAIAPSSSSSSSTFQVVVLDLQMAEMDGYEVAMRIRSRSWPLMVAMTVSLDEEMWDKCMQIGINGVVRKPVMLRAMESELRRVLLQA

SEQ ID NO: 142 - protein, 253 aa, Arabidopsis lyrata
MAISQQFLNPTLFKSLASTNKNSPSPFFRLKSTSTTFNFKPLTSSSSATIITRAAVSSSDSGESKSRETFHGLCFVLKDNIDTDQIIPAEYGTLIPSIPEDREKLGSFALNGLPKFYNERFVVPGEIKSKYSVIIGGDNFGCGSSREHAPVCLGAAGAKAVVAESYARIFFRNCVATGEIFPLESEVRICDECKTGDVVTIEHKEDGSSLLINHTTRKEYKLKPLGDAGPVIDAGGIFAYARKAGMIPSASSA

SEQ ID NO: 143 - protein, 450 aa, Arabidopsis lyrata
MCRKGNSHIYLLIIGKVALVSAYGIHQLHIFIFVLAVFHVLYCIITYALGKTKMKKWKSWERETKTIEYQYANDPERFRFARDTSFGRRHLNIWSKSTFTLWITCFFRQFFGSVTKVDYLTLRHGFIMAHLPAGSAARFDFQKYIERSLEQDFTVVVGISPLIWCIAVLFILTNTHGWDSYLWLPFIPLIVILIVGAKLQMIISKLGLRIQEKGDVVKGAPVVEPGDDLFWFGRPRFILFLIHLVLFTNAFQLAFFVWSTYEFTLKNCFHHKTEDIAIRITMGVLIQVLCSYITLPLYALVTQMGTSMRPTIFNDRVANALKKWHHTAKKQTKHGHSGSNTPHSSRPTTPTHGMSPVHLLHNYNNRSLDQQTSFTASPSPPRFSDYSGQGHGHQHFFDPESQNHSYQREITDSEFSNSHHPQVDMASPVREEKEIIEHVKVDLSEFTFKK

SEQ ID NO: 144 - protein, 427 aa, Arabidopsis lyrata
MAIPRFSSLLRCRKWAKSDWLVASIGFVLIVFFLSFFIDPTSDSVPSVDRSRPIIFPSDLVKLKLSSIAKERGAFCLDGSLPGYHFHEGSGSGSQSWLVHLEGGGWCNTVASCSARALTKLGSSNYFEQEVAFQGVLSSDPSQNPEFFNWNKVAIRYCDGASFAGHPEAEFKNETRLFFRGQLIWEAIIDELLSMGMSDAKQAILTGCSAGGLASLIHCDYFRDHLPKDAAVKCVSDGGYFLNVPDVLGNPTMRSFYHDVANLQGVDKSLDQKCEAKTKPSKCMFPQEFLKNIRTPVFLVNPAYDFWQIQNVLVPTSADPDKSWAKCRLNIKECDAAQMKVLHGFRSSMMDAIGEFHQSKDGGMFIDSCYAHCQTVMSVTWHSPTSPRIENKTIAESVGDWYFNRKPVKLIDCPYPCNPSCYNMNFT

SEQ ID NO: 145 - protein, 498 aa, Arabidopsis lyrata
MVQYQRLIIHHGRKEEKFRVSAEESGGGGCYSKRAKQKFRCLLFLSILSCCFVMSPYYLFGFSTLSLLDSFRREIEGLSSYEPFITPLCSEISNGTICCDRTGLRSDICEMKGDIRTNSASSSIFLFTSSTKNNTKPEKIKPYTRKWETSVMDTVQELNLITKDSNSSSDRVCDVYHDVPAVFFSTGGYTGNVYHEFNDGIIPLFITSQHYNKKVVFVIVEYHDWWEMKYGDIVSQLSDYPLVDFSGDARTHCFKEATVGLRIHDELTVNSSLVIGNQTIVDFRNVLDRGYSHRIQSLIQEETEANVTALDFKKKPKLVILSRNGSSRAILNENLLVELAEETGFNVEVLRPQKTTEMAKIYRSLNTSDVMIGVHGAAMTHFLFLKPKTVFIQIIPLGTDWAAETYYGEPAKKLGLKYIGYKIAPKESSLYEEYGKDDPIIRDPDSLNDKGWEYTKKIYLQGQNVKLDLRRFRETLTRSYDFSIRRRFREDYLLHRED

SEQ ID NO: 146 - protein, 309 aa, Canola
MVQYHRLIIHHGRKEERFRVSVEEVGSLKKAKQKFLSFLFLTILSCCFIVSPYLFGFSTLSLLDSFSRENEALSSYEPAPAPVCLEVSNGTICCDRTGLRSDICVMKGDIRTDSASSSLFLLTSTNNTTTPQKIKPYTRKWETSVMDTVQELNLITKHSNKSSDHVCDVYHDVPAVFFSTGGYTGNVYHEFNDGIIPLFITSQHYNKKVVFVIVEYHDWWEMKYGDIVSQLSDYPLVDFNGDSRTHCFKEATVGLRIHDELTVNSTLMSHGNKTIVDFRNVWTVLTRMVSKAWFKRKQKQRLTSRSRSW

SEQ ID NO: 147 - protein, 541 aa, Glycine max
MTLNIAALAVLCISVFGIAVVAEDPYRFFTWNVTYGDIYPLGVRQQGILINGQFPGPDIHSVTNDNLIINVFNSLDQPFLLSWNGVQQRRNSFEDGVLGTTCPIPAGGNFTYILQVKDQIGSFYYFPSLAFHKAAGGFGGIRILSRPRIPVPFDDPAGDYTVLIGDWYKLNHTDLKSQLDSGRKLPLPDGILINGRGSNGAYLNVEQGKTYRLRISNVGLENSLNLRIQNHKLKLVEVEGTHTLQTTYSSLDVHVGQSYSVLVTADQPAQDYYIVVSSRFTSTVLTTTGILRYSNSAGPVSGPPPGGPTIQIDWSLNQARSIRTNLTASGPRPNPQGSYHYGLINTTRTIILSGSPGIVNGKQRYAINSVSYVAPDTPLKLADYFKIPGVFRVGSISDRPTGGGIYLDTSVLQTDYRTFVEFVFQNDEDIIQSYHLDGYSFFVVGMDGGQWTPASRNTYNLRDAVSRSTTQVYPKSWTAIYIALDNVGMWNLRSEFWARQYLGQQFYMRVYTTSTSIRDEYPVPKNALLCGRASGRHTRPL

SEQ ID NO: 148 - protein, 543 aa, Glycine max
MTLKTAAVAVAIVCISAFSITVVAEDPYRFFNWNVTYGDIYPLGVRQQGILINGQFPGPDIHSVTNDNLIINVFNSLDQPFLLSWNGVQQRRNSFEDGVLGTTCPIPPGGNFTYILQVKDQIGSFYYFPSLAFHKAAGGFGGIRILSRPRIPVPFDDPAGDYTVLIGDWYKLNHTDLMSLLDSGRKLPFPNGILINGRGSNGAYFNVEQGKTYRLRISNVGLENSLNFRIQNHKLKLVEVEGTHTLQTTYSSLDVHVGQSYSVLVTADQPAQDYYIVVSTRFTSTVLTSTGVLRYSNSAGPVSGPPPGGPTIQIDWSLNQARSIRTNLTASGPRPNPQGSYHYGLINTTRTIILSSSPGIVNGKQRYAINSVSYVAPDTPLKLADYFKIPGVFRVGSFSDRPTGGGIYLDTSVLQTDYRTFVEFVFQNDEDIIQSYHLDGYSFFVVGMDGGQWTPASRNTYNLRDAVSRCTTQVYPKSWTAIYIALDNVGMWNLRSEFWARQYLGQQFYMRVYTTSTSIRDEYPVPKNALLCGRASGRHTRPL

SEQ ID NO: 149 - protein, 541 aa, Cacao
MPLNLAVALFCATASLFAIAGADDPYRFFNWNVTYGDIYPLGVRQTGILINGQFPGPDIHSVTNDNLIINVFNSLDEPFLLSWNGIQQRRNSYEDGVYGTTCPIPPGKNFTYILQVKDQIGSFYYFPSLAFHKAAGGFGGIRILSRPRIPVPFPDPAGDYTVLIGDWYKSNHTDLRAHLDLGKKLPFPDGILINGRGPGGASFNVEQGKTYRLRISNVGLQNSLNFRIQNHKLKLVEVEGTHTLQTTYSSIDIHVGQSSSVLFTADQPAQDYYIVVSTRFTNPVLTTTATLRYSNSAGPVSGPPPGGPTIQIDWSLNQARSIRTNLTASGPRPNPQGSYHYGLINTTRTIRLANSAGQVNGKQRYAVNSVSFVPADTPLKLADYFKIGGVFRVGSISDNPYGGGIYLDTSVMNADYRAFIEIVFQNDEDIVQSWHLDGYSFFVVGMDGGQWTAASRNQYNLRDAISRCTTQVYPKSWTAIYVALDNVGMWNLRSEFWARQYLGQQFYLRVYTDSSSLRDEYPIPKNALLCGRASGRSTRPL

SEQ ID NO: 150 - protein, 547 aa, Glycine max
MPLKLAGGATVGSLLLCVAISLFHIAGAEDPYRFFNWNVTYGDIYPLGVRQTGILINGQFPGPDIHSVTNDNLIINVFNSLDEPFLLSWNGIQQRRNSFEDGVFGTTCPIPPGKNFTYILQVKDQIGSFYYFPSLAFHKAAGGFGGIRILSRPRIPVPFPDPAGDYTVLIGDWYKSNHTTLKARLDRGKKLPFPDGILINGRGPNGVSLNVEQGKTYRLRISNVGLQHSLNFRIQNHKMKLVEVEGTHTLQTTYSSLDVHVGQSYSVLVTADQPAQDYYIVFSSRFSYKVLTTTGVLRYSNSAGPVSGPPPGGPTIQIDWSLNQARSIRTNLTASGPRPNPQGSYHYGMINTTKTIILASSAGQVNGKQRYAINSVSYVAPDTPLKLADYFKISGVFRPGSISDRPTGGGIYLDTSVLQADYRTFVEIVFQNNEKIVQSYHLDGYSFFVVGMDGGQWTPASRNQYNLRDAVARCTTQVYPFSWTAIYIALDNVGMWNLRSEFWARQYLGQQLYLRVYTASTSIRDEFPVPKNAILCGRASGRHTRPL

SEQ ID NO: 151 - protein, 541 aa, Gossypium hirsutum
MQLHSAVALICATVSLFVIAGAEDPYRFFNWNVTYGDIFPLGVHQTGILINGQFPGPDIHSVTNDNLIINVFNSLNEPFLLSWNGVQNRRNSYEDGVYGTTCPIPPGKNFTYILQVKDQIGSFYYFPSLGFHKAAGGFGGIRILSRPRIPVPFPDPAGDYTVLIGDWYKANHTDLRAQLDSGRKLPFPDGILINGRGPGGASFNVEQGKTYRLRISNVGLQNSLNFRIQNHKLKLVEVEGTHTLQTTYSSIDLHLGQSMSVLFTADQPAQDYYIVVSSRFTNPVLTSTATLRYSNSAGPVSGPPPGGPTIQVDWSLNQARSIRTNLTASGPRPNPQGSYHYGLINTTRTIRLANSAGQVNGKQRYAVNSVSFVPADTPLKLADFFKIDGVYRIGSISDNPTGGGIYLDTSVMNSDYRSFIEIVFQNDEDIVQSWHLDGYSFFVVGMDGGQWTAASRNGYNLRDAVSRCTTQVYPKSWTAIYVALDNVGMWNLRSEYWARQYLGQQFYLRVFTTSTSLRDEYPIPKNALLCGRASGRRTRPL

SEQ ID NO: 152 - protein, 548 aa, Vigna unguiculata
MHLKLAEKASVAVLLFSLLSISHFHFSVAEDPYRFFNWNVTYGDIFPLGVRQRGILINGQFPGPDIHSVTNDNLIINVFNSLDEPFLLSWNGIQQRRNSFEDGVFGTTCPIPPGKNFTYILQVKDQIGSFYYFPSLAFHKAAGGFGGIRILSRPRIPVPFPDPAGDYTVLIGDWYKSNHTTLKAHVDNGKKLPFPDGILINGRGPNGVAFNVEQGKTYRLRISNVGLQHSLNFRIQNHKMKLVEVEGTHTVQTTYSSLDVHVGQSYSVLVTADQPAQDYYIVASSRFSYKVLTTTAVLRYSNSAGPVSGPPPGGPTIQIDWSLNQARSIRTNLTASGPRPNPQGSYHYGLINTSRTIVLASSAGQVNGKQRYALNSVSYVAPDTPLKLADYFKISGVFRPGSISDRPTGGGIYLDTSVLQTDYRSFVEFVFQNNENIVQSYHLDGYSFFVVGMDGGQWTPASRNQYNLHDAVSRCTTQVYPMSWTAIYVALDNVGMWNLRSEFWARQYLGQQLYLRVFTTSTSIRDEFPVPKNAILCGRASGRHTRPL

SEQ ID NO: 153 - protein, 546 aa, Manihot esculenta
MPLSLAGRVAVCTLLCVAVSLFANVGAEDPYRFFNWNVTYGDIYPLGVRQTGILINGQFPGPDIHSVTNDNLIINVFNSLDEPFLLSWNGIQQRRNSYEDGVIGTTCPIPPGKNFTYILQVKDQIGSFYYFPSLAFHKAAGGFGGIRILSRPRIPVPFPDPDGDYTVLIGDWYKSNHTVLRAHLDRGKKLPFPDGILINGRGPNGYALTVEQGKTYRLRISNVGLQHSLNFRIQNHKMKLVEVEGTHTLQTTYSSLDVHVGQSYSVLVTADQPGQDYYIVVSSRFTTPILTTTGVLHYSNSAGPVSGPPPGGPTIQIDWSLNQARSIRTNLTASGPRPNPQGSYHYGMINTTRTIRFASSAGQVNGKQRYAVNSVSFVAPDTPLKLADYFKIQGVFRENSISDKPYGGGIYLDTSVLTVNYREFVEIVFENSENIVQSWHLDGYSFFVVGMDGGQWTSDSRNQYNLRDAVARCTTQVYPMSWTAIYVPLDNVGMWNLRSEFWARQYLGQQLYLRVYTASTSLRDEFPIPKNALLCGRASSRSTRPL

SEQ ID NO: 154 - protein, 542 aa, Citrus, Citrus reticulata, Citrus sinensis
MPLNLAVAASICSLFCSLFAIVSAEDPYRFFNWNVTYGDIYPLGVRQRGILINWQFPGPDIHSVTNDNLIINVFNSLDEPFLLSWNGIQNRRNSFEDGVYGTTCPIPPGKNFTYILQVKDQIGSFYYFPSLAFHKAAGGFGGIRILSRPRIPVPFPDPAGDYTVLIGDWYKSNHTDLRAHLDKGKKLPLPDGILINGRGSGAAFNVEQGKTYRLRISNVGLQNSLNFRIQNHKMKLVEVEGTHTLQTTYSSLDVHVGQSYSVLVTADQPARDYYIVVSSRFTSTVLTTTGILHYSNSAGPVSGPIPGGPTVQIDWSLNQARSIRSNLTASGPRPNPQGSYHYGLINTTKTIRLSSSAGQVNGKQRYAINSVSFIPADTPLKLADYFKIGGVFRIGSISDNPTGGGIYQDTAVMGADYRAFIEIVFQNDEDIIQSYHLNGYQFWVVGMDGGQWTSASRNQYNLRDAVARVTVQVYPKSWSAIYIALDNVGMWNLRSESWARQYLGQQFYLRVYTASTSLRDEYPIPKNARLCGKAAGRHTRPL

SEQ ID NO: 155 - protein, 546 aa, Ricinus communis
MPLSLAGTGAICTLFCIAVSFFAIVGAEDPYRFFNWNVTYGDIYPLGIRQQGILINGQFPGPDIHSVTNDNLIINVFNSLDEPFLLSWNGIQQRRNSYEDGVYGTTCPIPPGKNFTYILQVKDQIGSFYYFPSLAFHKAAGGFGGIRILSRPRIPVPFADPDGDYTILIGDWYKSNHTDLKAHLDNGKKLPFPDGILINGRGPSGYYLTVEQGKTYRLRISNIGLQNSLNFRIQNHKMKLVEVEGTHTLQTTYSSLDVHVGQSYSVLFTADQPGQDYYIVVSSRFTTQVLTTTGVLHYSNSAGSVSGPPPGGPTIQIDWSLNQARSIRTNLTASGPRPNPQGSYHYGMINTSRTIILASSAGQVNGKQRYAVNSVSFIPQDTPLKLADFFKIPGVFKENSISDRPYGGGIYLDTSVLTVDYRAFVEIVFQNNEDIVQSWHLDGYSFFVVGMDGGQWTSASRDQYNLRDAVARCTAQVYPMSWTAIYVPLDNVGMWNLRTEFWARQYLGQQLYLRVYTTSTSLRDEYPIPKNALTCGKASGRRTRPL

SEQ ID NO: 156 - protein, 541 aa, Canola
MAANASFAAALIVGFALLFAVTAESPYRFFEWNVTYGDIYPLGVRQQGILINGQFPGPDIHSVTNDNLIINVYNSLDEPFLLSWNGVQQRRNSYVDGVYGTTCPIPPGKNYTYILQVKDQIGSFYYFPSLAFHKAAGGFGGLRILSRPGIPVPFADPAGDNTVLIGDWYKSNHTDLKAQLDSGRKLPLPDGILINGRGSGATLNVEQGKTYRLRISNIGLQHSLNFRIQNHKMKVVEVEGTHTLQTTFSSLDVHVGQSYSVLVTADQPAQDYYVVVSSRFTSDVLTTTGVLRYSGSAGGVSGPIPGGPTIQIDWSLNQARAIRTNLTASGPRPNPQGSYHYGMINTTRTIRLASSAGQVNGKQRYAVNSVSFNPADTPLKLADYFKIDGVYRVGSIQSQPTGGGIYLDTSVMQTDYRTFIEIVFENSEDIVQSWHLDGYSFWVVGMDGGQWTPDSRNEYNLRDAVARCTVQVYPSSWTAIYIALDNVGMWNLRSEFWARQYLGQQFYLRVYTTSTSLRDEYPIPKNALLCGRASGRRTRPL

SEQ ID NO: 157 - protein, 544 aa, Prunus
MSLNFAGAAVSALLFLTSLFSIVAAEDPYRFFEWNVTYGDIYPLGVRQKGILINGQFPGPDIHSVTNDNLIINVFNSLDEPFLISWNGIQQRRNSFEDGVYGTTCPIPPGRNFTYILQVKDQIGSFYYFPSLAFHKAAGGFGGIRILSRPRIPVPFPDPAGDYTVLIGDWYKSNHTSLKAHLDAGKKLPFPDGILINGRGPGGFSFNFEQGKTYRLRISNVGLQHSLNFRIQNHKLKLVEVEGTHTLQTTYSSLDVHVGQSYSVLVTADQPGQDYYIVASSRFTTPILTTTGTLHYTNSAGRVSGPPPGGPTIQVDWSLNQARSIRTNLTASGPRPNPQGSYHYGLINTTKTYVLENSAGQVNGKQRYGVNSVSFVPADTPLKLADYFKIGGVFRVGSISDRPTGGGLYLDTSVLGADYRTFVEFVFQNNEDIIQSWHLDGYSFFVVGLDGGQWTPASRKEYNLRDAVSRCTVQVYPKSWTAIYVALDNVGMWNLRTEFWARQYLGQQLYLRVYTPSTSIRDEYPIPKNALLCGRATGRRTRPL

SEQ ID NO: 158 - protein, 541 aa, Gossypium hirsutum
MQLHLAVVLLCATAGLFAIAGAEDPYRFFDWNVTFGDIYPLGVRQTGILINGQFPGPDIHSVTNDNLIINVHNSLNEPFLISWSGIQQRRNSYEDGVYGTTCPIPPGKNFTYILQVKDQIGSFFYFPSLAFHKASGGFGGIRILSRPRIPVPFPDPAGDYTVLVGDWYKSNHTNLKARLDRGKKLPFPDGILINGRGPGGASFNVEQGKTYRLRISNVGLQNSLNFRIQNHRLTLVEVEGTHTLQTTYSSIDLHLGQSCSVLFKADQPAKDYYIAVSTRFTSRVLTSTAILRYSNSAGPVSGPPPGGPTIQIDWSLNQARSIRTNLTASGPRPNPQGSYHYGLINTTRTIRLANSAGQVNGKQRYAVNSVSFVPADTPLKLADYFKIGGVFHVGSISDNPYGGKIYLDTSVMQADYRAFIEIVFQNNENIVQSWHLDGYSFFVVGMDGGQWTTASRRGYNLRDAVSRCTTQVYPKSWTAIYVALDNVGMWNLRSEFWARQYLGQQFYLRVYTTSTSLRDEYPIPKNALLCGRASGRHTRPL

SEQ ID NO: 159 - protein, 544 aa, Medicago
MTLNLAAVGALLLCVSTSLFHITSAEDPYKFFNWNVTYGDIYPLGVRQRGILINGQFPGPDIHSVTNDNLIINVFNSLNEPFLISWNGIQQRRNSFEDGVSGTTCPIPPGRNFTYILQVKDQIGSFYYFPSLAFQKAAGGFGGIRILSRPRIPVPFPEPAGDYTVLIGDWYKSNHTTLKAHLDKGKKLPIPDGVLINGRGPNGLSFNVEQGKTYRLRISNVGLQHSLNFRIQNHKLKLVEVEGTHTLQTTYSSLDVHVGQSYSVLVTADQPSQDYYVVASTRFSSKILTTTAVLRYSNSAGAVSGPPPGGPTIQVDWSLNQARSIRTNLTASGPRPNPQGSYHYGLINTTKTIILASSPGQVNGKQRYGINSVSYVVPDTPLKLADYFKISGVFRVGSISERPTGGGLYLDTSVMQADYRSFVEIVFQNNENIVQSYHLDGYSFFVVGMDGGQWTTSSRNGYNLRDAVARCTTQVYPYSWTAIYVALDNVGMWNLRTEFWARQYLGQQFYLRVYTASTSIRDEFPIPKNARLCGRASGRHTRPL

SEQ ID NO: 160 - protein, 544 aa, Malus
MPLNGAEGAIWALLCLAALFSIAVAEDPYRFFEWNVTYGDIYPLGVRQKGILINGQFPGPDIHSVTNDNLIINVFNSLDEPFLLSWNGIQQRRNSFEDGVYGTTCPIPPGKNFTYILQVKDQIGSFYYFPSLAFHKAAGGFGGIRILSRPRIPVPFPDPAGDYTVLIGDWYKANHTTLKAHLDRGKKLPFPDGILINGRGPGGFSLNFEQGKTYRLRISNIGLQNSLNFRIQNHKMKLVEVEGTHTLQTTYSSLDVHVGQSYSVLVTADQPGQDYYLVASSRFTSPILTTTGTVHYANSAGKVSGPPPGGPTIQVDWSLNQARSIRTNLTASGPRPNPQGSYHYGLINLTKTYVLQNSAGQVNGKQRYGVNSVSFVPADTPLKLADYFKIGGVFRVGSISDRPTGGGLYLDTSVLGADYRAFVEIVFQNNEDIIQSWHLDGYSFFVVGMDGGQWTTASRNAYNLRDAVSRCTTQVYPKSWTAIYIPLDNVGMWNLRTEFWARQYLGQQLYLRVYTPSTSIRDEYPIPRNARLCGRASGRRTRPL

SEQ ID NO: 161 - protein, 548 aa, Populus
MPLNLACKPAVLCTFLCLTVSILSVVKAEDPYRFFDWNVTYGFIYPLGVRQQGILINGQFPGPDIHSVTNDNLIINVYNSLDEPFLLSWNGIQQRRNSYEDGVFGTTCPIPPGKNFTYILQVKDQIGSFYYFPSLGFHKAAGGFGGIRILSRPRIPVPFDDPAGDYTILIGDWYMSNHTKLKAILDSGRKLPFPNGILINGRGRNGYSLTVEQGKTYRLRISNVGLQNSLNFRIQNHKMKLVEVEGTHTLQTTYSSLDVHVGQSYSVLFTADQPGQDYYIVVTSRFTAPVVLNTTGILHYSNSAGPVSGPFPGGPTTQIDWSLNQARSIRTNLTASGPRPNPQGSYHYGMINTTRTIIVANSAGQVNGKQRYGVNSVSFIAPDTPMKLADYFKIQGVFKENSISDRPYGGGLYLDTSVLTLPYRAFVEIVFQNNEDIVQSWHLDGYSFFVVGMDGGQWTTASRNQYNLRDGVSRCTIQVYPKAWTAIYIPLDNVGMWNLRTEFWARQYLGQQFYLRVYTDSTSLRDEYPIPKNALLCGRASGRHTRPL

SEQ ID NO: 162 - protein, 540 aa, Vitis
ALNSFRAFLSIFSLLFTIVAAEDPYRFFTWNVTFGDIYPLGVRQQGILINGQFPGPDIYSVTNDNLIINVYNSLTEPFLLSWSGVQQRRNSYEDGVYGTTCPIPPGRNFTYILQVKDQIGSFFYFPSLDFHKAAGGFGGIRILSRPRIPVPFPDPAGDITVLIGDWYKANHTTLKAILDRGKKLHFPDGILINGRGPNGVSFTVEQGKTYRFRISNVGLQNSLNFRIQDHKMVLVEVEGTHTLQTTYSSLDVHVGQSYSVLVTADQPAQDFYIVVSTRFTSQVLTTTGILRYSNSAGPVSGPPPGGPTIQIDWSLNQARSIRTNLTASGPRPNPQGSYHYGMITTSRTIRLASSAGQVNGKQRYAVNSVSYVPGDTPLKVADFFKIGGVFRVGSISDNPTGGGVYLDTSVMGADFRAFVEIVFENPEDIIQSWHIDGYSFFVVGMDGGLWTANSRNQYNLRDAVARSTTQVYPKSWTAIYVALDNVGMWNVRSEFWARQYLGQQFYLRVYSPVESIRDEFPIPKNALLCGKASGRRTRPL

SEQ ID NO: 163 - protein, 549 aa, Arachis hypogaea
MPLKLGGGAAAFGAFLVLCVGFSLFAVTLAEDPYRFFNWNVTYGDIYPLGVRQRGILINGQFPGPDIHSVTNDNLIINVFNSLDEPFLLSWNGIQQRRNSFEDGVLGTTCPIPPGRNFTYILQVKDQIGSFYYFPSLNFHKAAGGFGGIRILSRPRIPVPFPDPDGDYTVLIGDWYKSNHTTLKAHLDRGKKLPLPDGILINGRGPNGAYLNVEQGKTYRLRISNVGLQHSLNFRIQNHKLKLVEVEGTHSLQTTYSSLDVHVGQSYSVLVTADQPAHDYYIVVSTRFNYKILTTTGVLHYSNSGGQVSGPIPGGPTIQIDWSLNQARSIRTNLTASGPRPNPQGSYHYGLINTTKTIILASSAGQVNRKQRYAINSVSYVAPDTPLKLADYFKISGVFRAGSISDRPYGGGIYLDTSVLQADYRSFVEIVFQNNENIVQSYHLDGYSFFVVGMDGGQWTTASRNSYNLRDAIARCTTQVYPYSWTAIYVALDNVGMWNLRSEFWARQYLGQQFYLRVYTDSNSIRDEFPVPKNALLCGKASGRHTRPL

SEQ ID NO: 164 - protein, 541 aa, Gossypium hirsutum
MPLHSAVALFYAAASLFAIAGAEDPYRFYSWNVTYGDIYPLGVRQTGLLINGQFPGPDIHSVTNDNLIINVYNNLNESFLLSWNGVQQRRNSYEDGVFGTTCPIPPGKNFTYMLQVKDQIGSFYYYPSLGFHKAAGGFGGIRILSRPRIPVPFPDPAGDYTVLIGDWYKSNHTVLQAHLDGGKKLPFPDGVLINGRGPGGASFNVEQGKTYRLRISNVGLQNSLNFRIQNHRLTLVEVEGTHTLQTTYSSIDLHLGQSCSVLFTADQPAQDYYIVASTRFTNPVLTTTATLRYSNSAGPVSGPPPGGPTIQIDWSLNQARSIRTNLTASGPRPNPQGSYHYGLINTTRTIRLANSAGQVNGKQRYAVNSVSFVLPDTPLKLADYFKIGGVFRPGSISDNPYGGGIYLDTSVLNADYRAFVEIVFENTENIIQSWHLNGYSFFVVGMDGGQWTAASRNGYNLRDAVARCTTQVYPKSWTAIYVALDNVGIWNLRSEYWARQYLGQQLYLRVYTDSTSLRDEYPIPKNALLCGRAAGRSTRPL

SEQ ID NO: 165 - protein, 212 aa, Raphanus sativus
MAANASFAAALLIGFSLLFAVMAESPYRFFDWNVTYGDIYPLGVRQQGILINGQFPGPDIHSVTNDNVIINVYNSLDEPFLLSWNGIQQRRNSYVDGVYGTTCPIPPGKNYTYILQVKDQIGSFYYFPSLAFHKAAGAFGGFRILSRPGIPVPFADPAGDYTVLIGDWYKSNHTDLKAQLDSGRKLPLPDGILINGRGSGATLNVEQVRHTG

SEQ ID NO: 166 - protein, 545 aa, Fragaria  ananassa
MPLNLGAISALLCLSLTASLLAVVTAEDPYRFFQWNVTYGDIYPLGVRQRGILINGQFPGPDINSVTNDNLIINVFNSLDEPFLLSWNGIQQRHNSFQDGVYGTTCPIPPGRNLTYILQVKDQIGSFYYFPSLAFHKAAGGFGGIRILSRPRIPVPFPDPSGDYTVLIGDWYKSNHTTLKAHLDRGKKLPFPDGILINGRGPNQFSLTFEQGKTYRLRISNVGLQHSLNFRIQDHKMKLVEVEGTHTLQTTYSSLDVHVGQSYSVLVTADQPGHDYYIVVSSRFSTPILTTTGILHYSGAGGQVSGPIPGGPTIQIDWSLNQARSIRTNLTASGPRPNPQGSYHYGLINLTKTYILASAAGQVNGKQRYGINSVSFVPADTPLKLADYFKISGVFRVGSVSDRPTGGNLYLDTSVLGADYRTFVEIVFQNDEDIVQSYHLDGYQFFVVGMDGGKWTTASRNGYNLRDAVARSTTQVYPFSWTAIYLSLDNVGMWNLRTEFWARQYLGQQLYLRVYTSSTSIRDEYPIPRNARLCGRASGRHTRPL

SEQ ID NO: 167 - protein, 385 aa, Manihot esculenta
MPLSLAGTRAVCILLCLAVASLFAIVGAEDPYRFFNWNVTYGDIYPLGVRQRGILINGQFPGPDIHSHLSALTIGFNLVASLMNSVEILQNGIQQRRNSYEDGVYGTTCPIPPGKNFTYILQVKDQIGSFYYFPSLAFHKAAGGFGGIRILSRPRIPVPFSDPDGDYTILIGDWYKSNHTDLKAQLDGGNKLPFPDGILINGRGPNGYALTVEQGKTYRLRISNVGLQHSLNFRIQNHKMKLVEVEGTHTLQNTYSSLDVHVGQSYSVLVTADQPGQDYYIVVSSRFTTPILTTTGVLHYSNSAGPVSGPPPGGPTIQIDWSLNQARSIRTNLTASGPRPNPQGSYHYGMINTTRTIRFANSAGQVNGKQRYAVNSVSLFQQIPH

SEQ ID NO: 168 - protein, 544 aa, Malus
MRVNGAGGAISALLCLAALFSIAVAEDPYRFFEWNVTYGDIYPLGVRQKGILINGQFPGPDIHSVTNDNLIINVFNSLDEPFLLSWNGIQQRRNSFVDGVYGTTCPIPPGRNFTYILQVKDQIGSFYYFPSLDFHKAAGGFGGIRILSRPRIPVPFPDPDGDYTVLIGDWYKSNHTTLKAHLDSGKKLPSPDGILINGRGPGGFSLNFEQGKTYRLRISNVGLQNSLNFRIQNHKMKLVEVEGTHTLQTSYSSLDVHVGQSYSVLVTADQPGQDYYVVASSRFTSPILTTTGTVHYANSAGAVSGPPPGGPTIQVDWSLNQARSIRTNLTASGPRPNPQGSYHYGLINLTKTYVLENSAGQVNGKQRYGVNSVSFVPADTPLKLADYFKIGGVFRVGSISDKPTGGGLYLDTSVLGADYRTFVEIVFQNNEDIIQSWHLDGYSFFVVGMDGGQWTTASRDAYNLRDAVSRCTTQVYPKSWTAIHIALDNVGMWNLRTEFWARQYLGQQLYLRVYTSSTSLRDEFPIPRNARLCGRASGQRTRPL

SEQ ID NO: 169 - protein, 541 aa, Arabidopsis lyrata
MAANASFAAALLIGLSLLFAVVAEDPYRFFEWNITYGDIYPLGVRQQGILINGQFPGPDIHSVTNDNLIINVYNSLDEPFLLSWNGIQQRRNSFVDGVYGTTCPIPPGKNYTYILQMKDQIGSFYYFPSLGFHKAAGGFGGIRILSRPRIPVPFPDPAGDTTVLIGDWYKSNHTDLRAQLDSGKKLPLPDGILINGRSSGATLNVEQGKTYRLRISNVGLQDSLNFRIQDHKMKVIEVEGTHTLQTTFSSLDVHVGQSYSVLVTADQTPRDYYVVVSSRFTSNVLTTTGILRYSNSAGAVSGPIPGGPTIQIDWSLNQARAIRTNLTASGPRPNPQGSYHYGMINTTRTIRLASSAGQVDGKQRYAVNSVSFKPADTPLKIADYFKIDGVFRSGSIQYQPTGGGIYLDTSVMQVDYRTFVEIVFENSEDIVQSWHLDGYSFWVVGMDGGQWSPDSRNVYNLRDAVARCTVQVYPSSWTAILIALDNVGMWNLRSEFWARQYLGQQLYLRVYTPSTSLRDEYPIPKNALLCGRASGRRTRPL

SEQ ID NO: 170 - protein, 540 aa, Tragopogon
MPRSFAACISVVALLVAIAGAEDPYRFFNWNVTYGDIYPLGVRQQGILINGQFPGPDIHSVTNDNLIINVFNSLPEPFLISWNGVQQRRNSFEDGVYGTTCPIPPGKNFTYILQVKDQIGSFYYFPSLAFHKAAGGFGGIRILSRPRIPVPFDEPAGDFTVLIGDWYKANHTTLKRVLDNGHKIPFPDGILINGRGPNGAYFTVEQGKTYRLRISNVGLQNSLNFRIQNHKMKLVEVEGTHTVQQTYSSLDVHCGQSYSVLFTADQPGHDYYIVVSSRFTTPVLTTTGVLHYSNSGGQVSGPIPGGPTIQVDWSLNQARSIRTNLTASGPRPNPQGSYHYGMINTSRTIILQSSAGQVGGKQRYGINSVSFKPADTPLKLADYFNIGGVFRVGSISDRPTGGGLYQDTSVMGADYRAFVEIVFENPADIVLSYHLDGYQFFVVGMDGGQWTQASRNGYNLRDGVARSTIQVYPKSWSAIYLGLDNVGMWNLRTEFWARQYLGEQFYLRVYTNSGSIRDEFPIPKNARLCGRATGFHTRPL

SEQ ID NO: 171 - protein, 541 aa, Cucumis sativus
MLPLTSPFFALCAFFCFFSTLSAENPYRFFTWNVSYANIYPLGVRQQGILINGQFPGPDVHCVTNDNLIINVFNSLDEPFLISWNGIQQRRNSYEDGVYGTTCPIPPGKNFTYILQVKDQIGSFYYFPSLAFHKAAGGFGGIRILSRPRIPVPFPDPAGDYTVLIGDWYKSNHTTLKAHLDRGKKLPFPDGILINGRANDTSFGVEQGKTYRLRISNVGLQHSLNFRIQGHKMKLVEVEGTHTLQTTYSSLDVHVGQSYSVLITADQPAQDYYIVVSTRFTSRVLATTGILRYSNSAGPVKGPPPGGPTIQIDWSLNQARSIRTNLTASGPRPNPQGSYHYGLINTTKTIILANSAGQVNRKQRYAVNSVSFVPADTPLKLADFFKIGGVFRVGSISDRPTGGGIYLDTSVMGVDYRAFVEIIFQNNENIVQSWHIDGYSFFVVGMDGGQWTQSSRNQYNLRDAIARCTTQVYPYSWTAIYVALDNVGMWNVRSEFWARQYLGQQFYLRVYTPSTSLRDEFPIPKNALLCGKATLSPPRGS

SEQ ID NO: 172 - protein, 546 aa, Euphorbia
  misc_feature (391)..(391): Xaa can be any naturally occurring amino acid
MPLKLAGKCSICTFLCLVASLFAIVGAEDPYRFFNWNVTYGDIYPLGVRQRGILINGQFPGPDIHSVTNDNLIINVYNSLDEPFLLSWNGVQQRRNSYVDGVYGTTCPIPPGQNYTYIMQVKDQIGSFYYFPSLGFHKAAGGFGGIRILSRPRIPVPFADPDGDYTILIGDWYKSNHTVLRAQLDGGKKLPLADGILINGRGPNGYSLTVEQGKTYRLRISNVGLQNSLNFRIQNHKMKLVEVEGTHTLQTTYSSLDVHLGQSYSVLFTADQPGQDYYIVVSSRFTSPVITTTGVLHYSNSAGPVSGPPPGGPTIQVDWSLNQARSIRTNLTASGPRPNPQGSYHYGMINTTRTIIFSSSAGQVNGKQRYAVNSVSFIPQDTPLKLADYFXIQGVFKENSIASKPYGGGIYLVTSVLTVDYRSYVEIVFVNDEDILQSYHLDGYSFFVVGMDGGQWTPASRNGYNLRDGVARCTIQVYPKSWSAIYIPLDNVGMWNLRSEYWARQYLGQQLYLRVYTSSTSLRDEYPIPKNALLCGKAAGRHTRPL

SEQ ID NO: 173 - protein, 539 aa, Aristolochia
MPLNVAAALSFIFFAVVVTAEDPYRFFTWNVTYGDIYPLGVRQQGILINGQFPGPDIHSVTNDNLIINVFNSLPEPFLISWNGIQQRRNSWEDGVYGTTCPIPPGRNFTYILQVKDQIGSLFYFPSLAFHKAAGGFGGIRILSRPRIPVPFPDPAGDFTVLIGDWYKANHTDLRAKLDRGKKLPLPDGILINGRGPNGAYFTVEQGKTYRFRISNVGLQNSLNIRFQNHKMKLVEVEGTHTVQNTYSSLDVHVGQSYSVLVTMDQPGLDYYIVVSTRFTNPVLTTTGTLHYSNSVGRVSGPPPGGPTIQIDWSLNQARSVRTNLTASGPRPNPQGSYHYGLINTTRTIVLANSAGLVDGKQRYAVNSVSFVPADTPLKLADFFKISGVFRVGSISDRPTGGGIYKDTSVLGADFRAYIEIVFQNDEDIVQSWHLDGYSFFVVGMDGGTWTTASRNSYNLRDAVSRCTTQVYPKSWTAIYMALDNVGMWNLRSEFWARQYLGQQFYLRVYSPVESIRDEYPIPRNARLCGRASGRHTRPL

SEQ ID NO: 174 - protein, 545 aa, Quercus
MPLNIAGSVLSAVLCITVFLFATVGAEDPYRFFNWNVTYGDIYPLGVRQQGILINGQFPGPDIHSVTNDNLIINVFNSLNEPFLLSWNGIQNRRNSFEDGVNGTTCPIPPGQNFTYILQVKDQIGSFYYFPSLAFHKAAGGFGGIRILSRPRIPVPFPDPAGDYTVLIGDWYKANHTDLKALLDRGKKLHFPDGILINGRGPGGAAYTVEQGKTYRFRISNVGLQHSLNFRIQGHRLTLAEVEGTHTLQTSYSSLDVHVGQSYSVLVTMDQPGQDYYIVVSSRFTTPILTTTGVLHYSNSAGPVSGPPPGGPTIQVDWSLNQARSIRTNLTASGPRPNPQGSYHYGLINTTKTIRLQNSAGLVDGKQRYAVNSVSYVAADTPLKIADYFQIQGVFRVGSISSNPTGGGIYLDTAVMGADYRAFIEIVFENTEDIIQSWHLDGYSFWVVGMDGGLWTTASRNQYNLRDAVSRVTTQVYPKSWTAIYLALDNVGMWNLRSEFWARQYLGQQFYLRVYTPSTSIRDEFPIPKNALLCGRAKGRHTRPL

SEQ ID NO: 175 - protein, 540 aa, Actinidia deliciosa
MPLNLAAVFCLAVSLFAVVGADDPYRFFNWNVTYGDIYPLGVRQQGILINGQFPGPDIYSVTNDNLIINVFNSLDEPFLLSWNGIQQRRNSYQDGVYGTTCPIPPGKNFTYILQVKDQIGSFYYFPSLAFHKAAGGFGGIRILSRPRIPVPFPDPAGDYTVLIGDWYKSNHTDLKAKLDRGKKLPLADGILINGRGPNGASFTVEQGKTYRLRISNVGLQNSLNFRIQGHRMTLVEVEGTHSVQTSYSWLDVHPGQSYSVLVKADQPAQDYFVAVSTRFTTDVLTTSAIFHYSNSAGPVSGPPPGGPTIQIDESLNQARSIRTNLTASGPRPNPQGSYHYGLINTTKTIRLANSAGLINGKQRYAVNSVSFVPADTPLKLADFFTIGGVFRVGSISDNPTGGGLYLDTSVLGVDYRAFIEIVFENKENIVQSWHLDGYSFFVVGMDGGLWSSASRSQYNLRDAISRSTVQVYPKSWTAIYVALDNVGMWNLRSEFWARQYLGQQLYLRVYTASTSLRDEFPIPKNALLCGRASGRHTRPL

SEQ ID NO: 176 - protein, 540 aa, Eucalyptus
MAGGAICASLAVALFFAIVGAENPYRFFDWNVTYGDIYPLGVRQQGILINGQFPGPDIHSVTNDNLIINVFNSLDVPFLISWSGIQQRRNSYEDGVYGTTCPIPPGRNFTYIFQVKDQIGSFFYFPSLKFHKAAGGFGGIRILSRPLIPVPFAEPAGDYTVLIGDWYKANHTTLIATLDRGKKLKYPDGILINGRGPNGISFDVQQGKTYRLRISNVGLMNSLNFRIQGHKMLLVEVEGTHVMQTHFSSLDVHVGQSYSVLVTADQPAQDYYIVVSTRFSSQILTTTGILRYSNSAGPVSGPPPGGPTIQIDWSLNQARAIRTNLTASGPRPNPQGSYHYGLITPTRTIRLSSSAGQVNGKQRYAVNSVSFIPADTPLKLADYFNIGGVFRVNSISDRPTGGGIYLDTAVLGVDYRAFVEIVFENNENIVQSWHLDGYSFFVVGMDGGQWTTASRNQYNLRDAVFRSTTQVYPYSWTAIYVALDNVGMWNLRTEFWARHYLGQQLYLRVYTTSTSLRDEFPIPKNALLCGRAQGRHTRPF

SEQ ID NO: 177 - protein, 538 aa, Amaranthus
MQPLLYLSIASLLVSFVVADDPYRFFNWNVTYGDIYPLGVRQQGILINGQFPGPDIHSVTNDNLIINVFNSLDVPFLLSWNGIQNRRNSFEDGVYGTTCPIPPGKNFTYILQVKDQIGSFYYFPSLGFQKAAGGFGGIRILSRPRIPVPFPDPAGDYTVLIGDWYKANHTDLQATLDAGHKLPPPDGILINGRGSGATINVEQGKTYRLRISNVGLQNSLNFRIQGHKMKVVEVEGTHTLQTTFSSLDVHVGQSYSVLITADQPPRDYYVVASSRFTNPVLTTTGFLRYSNSGGSVQGPIPGGPTIQIDWSLNQARAIRTNLTASGPRPNPQGSYHYGMINTTRTIRLQNSAGQVNGKQRYAVNSVSFIPADTPLKLADYFKIGGVFSVGSIPSNPTGSGIYLATSVMGADYRAFIEIVFENTEDIIQSWHLDGYSFFVVGMDGGTWSEASRNQYNLRDAVFRCTTQVYPNSWTAIYLALDNVGMWNLRSEFWARQYLGQQFYLRVYTPSTSLRDEYPIPKNALTCGRAAGRRTRPIV

SEQ ID NO: 178 - protein, 539 aa, Cucumis sativus
MPSSLLFLFISFFFAIVRAEDPYRFFDWNVTYGTIYPLGLPQQGILINGQFPGPDIHSVTNDNIIINVFNSLDEPFLLSWNGIQQRRNSYEDGVYGTTCPIPPGKNFTYILQMKDQIGSFYYFPSLGFHKAAGGFGGIRILSRPRIPVPFPDPAGDYTVLIGDWYQANHTTLRAQLDNGSMLPLPDGILINGRGPNRTASINVEQGKTYRLRISNVGLQSSLNFRIQGHRMKVVEVEGTHTLQTEFSSLDIHVGQSYSVLVTADQPAQDFYIVVSSRFTTPILSTTAILRYANSAGSVQGPPPGGPTIQIDWSLNQARAIRTNLTASGPRPNPQGSYHYGMITTTRTIVVANSAGIVDGKQRYAVNSVSFIPADTPLKVADFFKIGGVFRVGSISDWPNGGGIYQDTSVMGADYRAFVEIVFQNNEDLIQSWHLDGYSFFVVGMDGGQWTSNSRNQYNLRDAIARCTVQVYPKSWSAIYVALDNVGMWNIRTEFWARQYLGQQFYLRVYTPSTSLRDEYPIPKNALLCGRATGRRTRPL

SEQ ID NO: 179 - protein, 541 aa, Lactuca sativa
MPRSFALCIAVGAALLAIAGAEDPYRFFNWNVTYGDIYPLGVRQQGILINGQFPGPDIHSVTNDNLIINVFNSLTEPFLVSWNGVQQRRNSYEDGVFGTTCPIPPGKNFTYILQVKDQIGSFYYFPSLAFHKAAGGFGGIRILSRPRIPVPFDEPAGDYTVLIGDWYKANHTTLKTVLDGGHKIPFPDGILINGRGPGGASFAVEQGKTYRLRISNVGLQNSLNFRIQNHKMKLVEVEGTHTVQQTYSSLDVHCGQSYSVLITADQPGQDYYIVVSSRFTTPILTTTGVLHYANSAGQPSGPIPGGPTIQVDWSLNQARSIRTNLTASGPRPNPQGSYHYGMINTSRTIVLQSSAGQVGGKQRYGINSVSFKPSDDTPLKLADYFNIGGVFRVGSISDRPTGGGLYTDTSVMGADYRAFVEIVFENPSDIVLSYHIDGYQFFVVGMDGGEWTQASRAGYNLRDGVARSTIQVYPKSWSALYVGLDNVGMWNVRTEFWARQYLGEQFYLRVYTNSGSIRDEFPIPKNARVCGKATGRHTRPL

SEQ ID NO: 180 - protein, 162 aa, Brassica rapa
VFSILFTVTAEDPYRFFNWNVTYGDIYPLGVRQQGILIDGKFPGPDIHSVTNDNLVINIFNNLDEPFLLSWNGVQQRRNSYVDGVYGTTCPIPPGKNYTYMLQVKDQIGSFYYFPSLAFHKAAGGFGGIRILSRPRIPVPFLTPPEITLFSSETGTNPITRI

SEQ ID NO: 181 - protein, 547 aa, Populus
MPLNLAGKTAVLCTFLCVSVSIISSVKAEDPYRFFDWNVTYGFIYPLGVRQQGILINGQFPGPDIHSVTNDNLIINVYNSLDEPFLLSWNGIQQRRNSFEDGVIGTTCPIPPGKNFTYILQVKDQIGSFYYFPSLGFHKAAGGFGGIRILSRPRIPVPFDDPAGDYTILIGDWYLSNHTDLKAVLDGGRKLPFPDGILINGRGRNGYYLTVEQGKTYRLRISNVGLQNSLNFRIQNHKMKLVEVEGTHTLQTTYSSLDVHVGQSYSVLFTADQPGQDYYIVVTSRFTSTVLNTTGILHYSNSAGAVSGPFPGGPTIEVDWSLNQARSIRTNLTASGPRPNPQGSYHYGMINTTRTIIVANSAGQVNGNQRYGVNSVSFIAPDTPMKIADYFKIQGVFKENGITDRPYGGGLYLDTAVLTVPYRAYVEIVFQNDEDILQSWHLDGYSFFVVGMDGGQWTTASRDQYNLRDAVARCTTQVYPKAWTAIYIPLDNVGMWNLRTEFWARQYLGQQFYLRVYTDSTSLRDEFPIPKNALLCGRASGRRTRPL

SEQ ID NO: 182 - protein, 538 aa, Glycine max
MPLKLAGVATVGSLLLCVAISLFHIAGAEDPYRFFNWNITYGDIYPLGVRQTGILINGQFPGPDIHSVTNDNLIINVFNSLDEPFLLSWNGIQQRRNSFEDGVFGTTCPIPAGKNFTYILQVKDQIGTFYYFPSLAFHKAAGGFGGIRILSRPRIPVPFPDPAGDYTVLIGDWYKSNHTTLKARLDRGKKLPFPDGILINGRGPNGVSFNVEQGKTYRLRISNVGLQHSLNFRIQNHKMKLVEVEGTHTLQTMYSSLDVHVGQSYSVLVTADQPAQDYYIVVSTRFSYKVLTTTGVLRYSNSAGPVSGPPPGGPTIQIDWSLNQARSIRTNLTASGPRPNPQGSYHYGMINTTKTIILASSAGQVNGKQRYAINSVSYVVPDTPLKLADYFKISGVFRPGSISDRPTGGGIYLDTSVLQADYRNFVEIVFQNNENIVQSYHLDGYSFFVVGMDGGQWTTASRNQYNLRDAVARCTTQVYPFSWTAIYIALDNVGMWNLRSEFWARQYLGQQLYLRVYTNNTNLNQRRVPCSKECNSLW

SEQ ID NO: 183 - protein, 543 aa, Eucalyptus
MRQGLEGAGALFLCACVAFLAIAGAEDPYRFFNWNVTYGDIYPLGVRQQGILINGQFPGPDIYSVTNDNLIINVINSLNEPFLLSWNGIQQRRNSFEDGVYGTTCPIPPGKNFTYILQVKDQIGSFYYFPSLAFHKAAGGFGGIRILSRPLIPVPFPPPAGDYTILIGDWYKANHTDLRAILDNGKVLPFPDGILINGRGSGASFTVEQGKTYRLRISNVGLMNSLNFRIQGHKMVLAEVEGTHTVQNTYESLDVHVGQSLSVLVTADQPGKDYYIVVSSRFTTQVLTTTGVLHYSNSAGPVSGPVPGGPTTQIDWSLNQARSIRTNLTASGPRPNPQGSYHYGMINTTRTIRLANSAGPVNGKQRYAVNSVSFIPADTPLKLADYFKIDGVFRVGSISDNPTGSGIYLDTSVMRVDYRAYIEIVFENSEDTIQSWHLNGYAFFVVGMDGGQWTPASRNQYNLRDGVSRCTIQVYPKSWSAIYIPLDNVGMWNLRSESWARQYLGQQFYMQVYTTSTSLRDEYPIPKNAILCGRASGRHTRPL

SEQ ID NO: 184 - protein, 541 aa, Arabidopsis
MAGSASFAAALFIGLSLLFAVTAEDPYRFFEWNITYGDIYPLGVRQQGILINGAFPGPDIHSVTNDNLIINVYNSLDEPFLLSWNGIQQRRNSFVDGVYGTTCPIPPGKNYTYILQMKDQIGSFYYFPSLGFHKAAGGFGGIRILSRPRIPVPFPDPAGDTTVLIGDWYKANHTDLRAQLDNGKKLPLPDGILINGRSSGATLNVEQGKTYRFRISNVGLQDSLNFRIQDHKMKVVEVEGTHTLQTTFSSLDVHVGQSYSVLVTADQTPRDYYVVVSSRFTSNVLTTTGIFRYSNSAGGVSGPIPGGPTIQIDWSLNQARAIRTNLSASGPRPNPQGSYHYGMINTTRTIRLASSAGQVDGKQRYAVNSVSFKPADTPLKIADYFKIDGVYRSGSIQYQPTGGGIYLDTSVMQVDYRTFVEIIFENSEDIVQSWHLDGYSFWVVGMDGGQWSPDSRNEYNLRDAVARCTVQVYPSSWTAILIALDNVGMWNLRSEFWARQYLGQQLYLRVYTPSTSLRDEYPIPKNALLCGRASGRSTRPL

SEQ ID NO: 185 - protein, 546 aa, Castanea
MPLNLAGGVLSGAVLCVTVFLFATVGAEDPYRFFNWNVTYGDIYPLGVRQQGILINGQFPGPDIHSVTNDNLIINVFNSLDEPFLLSWNGIQNRRNSFEDGVNGTTCPIPPGQNFTYILQVKDQIGSFYYYPSLAFHKAAGGFGGIRILSRPRIPVPFPDPAGDYTVLIGDWYKANHTDLKDILDRGKKLHFPDGILINGRGPGGAYYTVEQGKTYRFRISNVGLQHSLNFRIQGHRLTLVEVEGTHTLQTSYSSLDVHVGQSYSVLVTMDQPGQDYYIVVSSRFSTPILTTTGVLHYSNSAGAVSGPPPGGPTIQVDWSLNQARSIRTNLTASGPRPNPQGSYHYGLINTTKTIRLQNSAGLVSGKQRYAVNSVSYVAADTPLKIADYFQIQGVFRVGSISSNPTGGGIYLDTAVMGADYRAFIEIVFENTEDIIQSWHLNGYSFWVVGMDGGLWTTASRNQYNLRDAVSRVTTQVYPKSWTAIYLALDNVGMWNLRTEFWARQYLGQQFYLRVYTPTTSIRDEFPIPKNALLCGRAKGRHTRPL

SEQ ID NO: 186 - protein, 540 aa, Nicotiana tabacum
MVPLKLAIAAFLVVGLVVNTVAEDPYRFFEWNVTYGTIYPLGVPQQGILINGQFPGPDIYSVTNDNLIINVFNSLDEPFLLSWNGIQNRRNSFEDGVYGTTCPIPPGKNFTYILQMKDQIGSYYYFPSLAFHKAAGGFGGIKILSRPRIPVPFPDPADDYTVLIGDWYKKNHTALKAILDGGKKLPFPDGILINGRGPNGVSFTVEQGKTYRLRISNVGLQNSLNFRIEGHKMKLVEVEGTHTLQTTYSSLDVHVGQTYSVLITADQEAKDHYIVVSSRFTSPVLTTTGVLHYSNSNTPVSGPPPGGPTIQIDWSLNQARSIRTNLSASGPRPNPQGSYHYGMINTTRTIRLASSAGQVNGKQRYAVNSVSFVPLDTPLKLLDYFKVGGFRVGSISDAPSGGGIFLDTSVLGADYRQFIEIVFENNEDIVQSWHLNGYSFWVVGMDGGQWTQASRNGYNLRDAVARCTTQVYPKSWTAIYIALDNVGMWNLRTEFWARQYLGQQLYMRVYTTSTSLRDEYPIPRNARLCGKVAGRHTRPL

SEQ ID NO: 187 - protein, 540 aa, Helianthus annuus
MPRNVAVLIAVGAVLVAIAGAEDPYRFFTWNVTYGDIYPLGVRQQGILINGQFPGPDIHSVTNDNLIINVFNSLPEPFLISWNGIQQRRNSFEDGVYGTTCPIPPGKNFTYILQVKDQIGSFYYFPSLAFHKAAGGFGGIRILSRPRIPVPFDEPAGDFTVLIGDWYKANHTILRRVLDAGHRIPFPAGILINGRGPGGASFTVEQGKTYRLRISNVGLQNSLNFRIQNHKMKLVEVEGTHTVQQTYSSLDVHLGQSYSVLFTADQPGQDYYIVVSSRFTTPILTTTGVLHYSNSAGQVSGPIPGGPTIQVDWSLNQARSIRTNLTASGPRPNPQGSYHYGMINTSRTIILQSSSGQVNGMQRYGINSVSFKPADTPLKLADYFNIGGVFRVGSISDRPTGGGLYEDTSVMGADFRAYVEIVFENPSNIVLSYHIDGYQFFVVGMDGGQWTQASRNGYNLRDGVARSTIQVYPKSWSAIYVALDNVGMWNVRTEYWARQYLGEQFYLRVYTNSGSIRDEFPIPKNARLCGRAAGRHTRPL

SEQ ID NO: 188 - protein, 542 aa, Arabidopsis lyrata
MTVGRSGGTVVLLFCLSFFAAVTAESPYRFFDWNVTYGDIYPLGVRQQGILINGKFPGPDIHSVTNDNLIINVHNSLDEPFLISWNGIQNRRNSYVDGMYGTTCPIPPRSNYTYILQVKDQIGSFYYFPSLAFHKAAGGFGGIRILSRPGIPVPFADPAGDYTVLIGDWYKSNHTDLKSRLDRGRKLPPPDGILINGRSNGATLNVEQGKTYRLRISNVGLQDSLNFRIQNHRMKLVEVEGTHTLQTMFSSLDVHVGQSYSVLITADQSPRAYYVVVSSRFTDKIITSTGVLRYSGSSTPASGPIPGGPTIQVDWSLNQARAIRTNLTASGPRPNPQGSYHYGLIPLIRTIVFGSSAGQINGKQRYGVNSVSFVPADTPLKLADFFKISGVYKINSISDKPTYGGLYLDTSVLQVDYRTFIEIVFENQEDIVQSYHLNGYSFWVVGMDGGQWKTGSRNGYNLRDAVSRSTVQVYPKSWTAIYIALDNVGMWNLRSEFWARQYLGQQLYLRVFTSSTSLRDEYPIPKNSRLCGRARGRHTRPL

SEQ ID NO: 189 - protein, 541 aa, Arabidopsis
MAVGRSGGTILLFCLSFFAAVTAESPYRFFDWNVTYGDIYPLGVRQQGILINGQFPGPDIHSVTNDNLIINVHNSLDEPFLISWNGVQNRRNSYVDGMYGTTCPIPPRSNYTYILQVKDQIGSFYYFPSLAFHKAAGGFGGIRILSRPGIPVPFADPAGDYTVLIGDWYKFNHTDLKSRLDRGRKLPSPDGILINGRSNGATLNVEQGKTYRLRISNVGLQDSLNFRIQNHRMKLVEVEGTHTLQTMFSSLDVHVGQSYSVLITADQSPRDYYVVVSSRFTDKIITTTGVLRYSGSSTPASGPIPGGPTIQVDWSLNQARAIRTNLTASGPRPNPQGSYHYGLIPLIRTIVFGSSAGQINGKQRYGVNSVSFVPADTPLKLADFFKISGVYKINSISDKPTYGGLYLDTSVLQVDYRTFIEIVFENQEDIVQSYHLNGYSFWVVGMDGGQWKTGSRNGYNLRDAVSRSTVQVYPKSWTAIYIALDNVGMWNLRSEFWARQYLGQQLYLRVFTSSTSLRDEYPIPKNSRLCGRARGRHTRPL

SEQ ID NO: 190 - protein, 224 aa, Arabidopsis lyrata
MAEKEEDVKLLGFWASPFSRRVEMALKLKGVPYEYLEQDIVNKSPLLLQLNPVYKKVPVLVHKGKVLSESHVVLEYIDQIWKNNPILPQDPYEKAMALFWAKFVDEQVGPVAFRYVAKAEKGIEVAIKEAQELFMFLEKEVTGKDFFGGETIGFLDLVAGSMIPFCLARGWEGMGIDMIPEEKFPELNRWIKNLKEIEIVRECIPPREKQIEHMKKVVERIKPA

SEQ ID NO: 191 - protein, 223 aa, Raphanus sativus
MAEREEDVKLLGFWASPFSRRVEMALKLKGVPYEYLEQDLMNKSPLLLELNPVYKKVPVLVHKGKILLESQLILEYIDQTWTNNPILPRDPYEKAMALFWAKVVDEQVKIRFSTLVKAEKGVEVAIEEARELLTFLEKEVTGKYLFGGKTIGFLDMVAGSMIPFCLARGWEGMGIDMIPEEKFPELNRWIKNLQEIEIVTECIPHREKQIEHMKKVAVRIKSA

SEQ ID NO: 192 - protein, 224 aa, Raphanus sativus
MANKEKDVKLLGFWASPFSRRVEMALKLKGVSYEYLEQDIVDKSALLLELNPVFKKVPVLVHNGKILAESHLILEYIDQTWKSNPILPQDPYEKAMARFWAKFVDEQVGPVCFKSVVKAEKGIEIAIEEAQELITFLEKELTGKDFFGGKTIGFLDLVAGSMIPFCLARSWEGMEIDMIPEEKFPELNRWIRNLNDIEVVSECIPHREKQIEHMMKVVERIKLA

SEQ ID NO: 193 - protein, 224 aa, Canola
MATKEEDVKLLGFWASPFSRRVEIALKLKGVTYEYLEQDIFNKSALLLELNPVFKKVPVLVHKGKILAESHLILEYIDQTWKNNPILPQDPYEKAMARFWAKFVDEQVGPVCFKSVVKADKGIDVAIEEAQELITFLEKELIGKDFFGGKTIGFLDMVAGSMIPFCVARAWEGMEIDMIPEEKFPELNRWIKNLNGIEIVRECIPNREKQIDHMMKVAERIKLA

SEQ ID NO: 194 - protein, 224 aa, Brassica rapa, Canola
MATKEEDVKLLGFWASPFSRRVEIALKFKGVSYEYLEQDIFNKSALLLELNPVFKMVPVLVHKGKILAESLLILEYIDQTWKNNPILPQDPYEKAMARLWAKFVDEQVGPVCFKSVVKADKGIDVAIEEAQELITFLEKELSGKDFFGGKTIGFLDMVAGSMIPFCVARAWEGMGIDMIPEEKFPELNRWIKNLNDIEIVRECIPQREKQIEHMMKVAERIKLA

SEQ ID NO: 195 - protein, 86 aa, Arabidopsis lyrata
MANVSALLTIALLLCSTLMCTARPEPAISVSITTAADPCNMEKKIEGKLDDMVEENCGSDDEDCLMRRTLVAHTDYIYTQKKKKNL

SEQ ID NO: 196 - protein, 1115 aa, Medicago
MEASSSSSCRSSSTTSLCSYHVFLSFRGEDTRKGFTDHLCAALERKGITTFRDDKDLERGQVISEKLINAIKDSMFAITVLSPDYASSTWCLDELQMIMECSNKGLEVLPVFYGVDPSDVRHQRGCFEESFRKHLEKFGQHSDRVDRWRDAFTQVASYSGWDSKGQHEALLVESIAQHIHRKLVPKLSSCTENLVGIESKVEEVNKLIGMGLNDVRFIGIWGMGGIGKSTIARAVYEAIRCEFQLTCFLENVREISETNGLVHLQRQLLSHMSISRNDFHNLYDGKKTIQNSFRRKKVLLVLDDVNELNQLENMAGKQDWFGPGSRVIITTRDKHLLMTHGVHKTYEVWMLFQNEALNLFCLKAFKGDKPQEGYLDLSKEVVDYTGGLPLALEVFGSYLYGRNVDLWHSAIKKIRSVPLRKIQDKLEISYESLDPMEKDVFLDIACFFKGMKIDKVIDILENCGYFPKIIIQVLIDRSLITLDRVNNKLGMHDLLQEMGRNIVFQESPNDPGRCSRLWSKEDIDSVLTKNKGTEKISSVVLNLLQPYEARWSTEAFSKTSQLKLLNLNEVQLPLGLSCLPCSLKVLRWRGCPLKTLAQTNQLDEVVDIKLSHSKIEKLWHGVYFMEKLKYLNLKFSKNLKRLPDFSGVPNLEKLILKGCSILTEVHLSLVHHKKVVVVSLKNCKSLKSLPGKLEMSSLKKLILSGCSEFKFLPEFGEKMENLSILALKGTDIRKLPLSLGSLVGLTNLNLKDCKSLVCLPDTIHGLNSLIILNISGCSRLCRLPDGLKEIQCLKELHANDTAIDELPSFIFYLDNLKVLSFAGCQGPPAMSTNWFPFNWMFGGQSASTGFRLPTSFLSLHSLKYLNLSYCNLSEESIPNYFHHLSSLKSLDLTGNNFVIIPSSISKLSRLRFLCLNWCEQLQLLPELPSRIMQLDASNCDSLETRKFDPIESFMKGRCLPATRFDMLIPFPGDEIPSWCVSQGSVSWAKVHIPNNLPQDEWVGFALCFQLVSYTFPPELCNHEIDCYLFSPNGKQLILISTRRLPPMDPCYPHLYILYLSIEQFRDKILQDDYWDGVEFSLKCYCCHSLRIFSSGCRLVCKQVVEVFQDQTVVSP

SEQ ID NO: 197 - protein, 300 aa, Arabidopsis lyrata
MAQKVEAAGGTGGASWDDGVHDGVRKVHVGQGQDGVSSIKVVYAKDSQDVEGGEYGKKTLLGFETFEVDADDYIVAVKVTYDNVFGQDSDIITSITFTTFKGKTSPPYGLETEKKFVLKDKNGGKPVGFHGRAGEALHALGAYFATTTTPGTPAKKLSAIGGDEGTAWDDGAYDGVKKVYVGQGQDGISAVKFEYNKGAEDILGGEHGKRTLLGFEEFELDYPSEYITAVEGTYDRIFGSDGVVITMLRFKTNKQMSAPFGLEAGTAFELKEEGHKIIGFHGKASELLHQFGVHVMPITN

SEQ ID NO: 198 - protein, 300 aa, Arabidopsis
MAQKVEAQGGIGGDVWDDGAHDGVRKVHVGQGLDGVSFINVVYENGSQEVVGGEHGKKSLIGIETFEVDADDYIVAVQVTYDKIFGYDSDIITSITFSTFKGKTSPPYGLDTENKFVLKEKNGGKLVGFHGRAGEILYALGAYFTTTTTPLTPAKKLPAVGGDEGTAWDDGAFDGVKKVYIGQAQDGISAVKFVYDKGAEDIVGDEHGNDTLLGFEEFQLDYPSEYITAVEGTYDKIFGFETEVINMLRFKTNKKTSPPFGIEAGTAFELKEEGCKIVGFHGKVSAVLHQFGVHILPVTN

SEQ ID NO: 199 - protein, 300 aa, Arabidopsis lyrata
MVQKVEAQGGMGGNVWDDGVHDGVRKVHVGQGQDGVSFINVVYENGSEEVVGGEHGKKSLIGIETFEVDADDYIVAVQVTYDKIFGFDSEVITSITFSTFKGKTSPPFGLDTENKFVLKEKNGGKLVGFHGRAGEILYALGAYFTTTTTPLNPAKKLPAVGGDEGTAWDDGAYDGVKKVYIGQAQDGISAVKFVYDKGAADIVGDEHGNDTLLGFEEFQLDYPSEYITAVEGTYDKIFGSETEVINMLRFKTNKQTSPPFGIEAGTAFELKEEGSKIVGFHGKVSSLLHQFGVHVLPVTN

SEQ ID NO: 200 - protein, 300 aa, Raphanus sativus
MAQKVEAQGGVGGDVWDDGVYDGVRKVHVGQGQDGVSFINAVYEKGSQEVEGGEHGNKTLLGFETFEVDADDYIIAVQVTYDKIFGHESDVITSITFYTSKGKASPPYGLETDKKFVLKEKNGGKLLGFHGRAGEVLHALGAYFVTTTTPLTPAKKLPAVGGDGGTAWDDGAYDGVRKLFVGQAQDGISVVKFVYDKGAEEIIGDEHGNSTLLGFEEFVLDYPSEYITSVEGTYDKIFGSDSEVVTMLRFKTNKQTSAPFGIEAGTPFELKEEGSKIVGFHGKVSELLHQFGVHVLPITY

SEQ ID NO: 201 - protein, 578 aa, Arabidopsis lyrata
MAVTEVENPLLGEITCGTLLQKLQEIWDEVGESDEERDKLLLQIEEECLNVYKKKVELAAKSRAELLQTLSDATVELSNLTTALGEKSYIDIPDKTSGTIKEQLSAIAPALEQLWQQKEERVRAFSDVQSQIQKICEEIAGGLNNGPHVVDESDLSLKRLDDFQRKLQELQKEKSDRLQKVLEFVSTVHDLCAVLGLDFLSTVTEVHPSLDEANGVQTKSISNETLARLAKTVLTLKEDKMQRLKKLQELATQLTDLWNLMDTPDEERELFDHVTCNISASVHEVTASGALALDLIEQAEVKVDRLDQLKSSRMKEIAFKKQSELEEIYARAHIEIKPEVVRERIMSLIDAGNTEPTELLADMDSQIAKAKEEAFSRKEILDRVEKWMSACEEESWLEDYNRDQNRYSASRGAHLNLKRAEKARILVSKITAMVDTLVAKTRAWEEDNSMSFEYDGVPLLAMLDEYTMLRQEREDEKRRLKEQKKQQEQPHTDQDSAFGSKPSPARPVSAKKTVGTRANGGGLNETPIRRLSMNSSQNGSKSKRDSLNKIASPSNLVANTKEDGASPVCRVDPVMASP

SEQ ID NO: 202 - protein, 587 aa, Arabidopsis lyrata
MAVTDAESPHLGEITCGTLLQKLQEIWDEVGESDEQRDKLLLQIEQECLDVYKRKVEQAAKSRAELLQTLSDANAELSSLTTSLGEKSLVGIPDKSSGTIKEQLAAIAPALEQLWQQKEERVREFSDVQSQIQKICGEIAGGLSNEVPIVDESDLSLKKLDDFQSQLQELQKEKSDRLHKVLDFVSTVHDLCAVLGLDFLSTVTEVHPSLDEETGVQSKSISNETLSRLAKTVLTLKDDKKQRLQKLQELATQLIDLWNLMDTPDEERELFDHVTCNISSSVDEVTVPGALARDLIEQAEVEVHRLDQLKASRMKEIAFKKQSELEEIYARAHVEINPESARERIMSLIDTGNVEPTELLADMDSQIAKAKEEAFSRKDILDRVEKWMSACEEESWLEDYNRDQNRYSASRGAHLNLKRAEKARILVSKIPAMVDTLVAKTRAWEEEHSMSFAYDGVPLLAMLDEYGMLRQEREEEKRRLREQKKVQEQPHIEQDSAFSTRPSPARPVSAKKTVGPRANNGGANGTPNRRLSLNANQNGSRSTAKEAGRRETLNRPAAPTNYVAISKEEAASSPVSGAVDHKVPASP

SEQ ID NO: 203 - protein, 587 aa, Arabidopsis
MAVTDTESPHLGEITCGTLLEKLQEIWDEVGESDDERDKLLLQIEQECLDVYKRKVEQAAKSRAELLQTLSDANAELSSLTMSLGDKSLVGIPDKSSGTIKEQLAAIAPALEQLWQQKEERVREFSDVQSQIQKICGDIAGGLSNEVPIVDESDLSLKKLDDFQSQLQELQKEKSDRLRKVLEFVSTVHDLCAVLGLDFLSTVTEVHPSLDEDTSVQSKSISNETLSRLAKTVLTLKDDKKQRLQKLQELATQLIDLWNLMDTPDEERELFDHVTCNISSSVDEVTVPGALARDLIEQAEVEVDRLDQLKASRMKEIAFKKQSELEEIYARAHVEVNPESARERIMSLIDSGNVEPTELLADMDSQISKAKEEAFSRKDILDRVEKWMSACEEESWLEDYNRDQNRYSASRGAHLNLKRAEKARILVSKIPAMVDTLVAKTRAWEEEHSMSFAYDGVPLLAMLDEYGMLRQEREEEKRRLREQKKVQEQPHVEQESAFSTRPSPARPVSAKKTVGPRANNGGANGTHNRRLSLNANQNGSRSTAKEAGRRETLNRPAAPTNYVAISKEEAASSPVSGAADHQVPASP

SEQ ID NO: 204 - protein, 197 aa, Arabidopsis lyrata
MIKSVTLRSFHLPIEFNDTKFAAPSFPPARSFPVVRCSSTRDVPKLELFSRGKFDRILQDPPLIEKAETELSDYCSTLEGDDSYSCWRAYFELKDLEREKPKVEVENLILQTGGVKSLIGCLHGVASMEKDNKTKNGLNREKGMKLHIHIPDGLPKSEQELEEEEKSKMPDSAFTRLLRTKGTIPAWFSHAPDHETD

SEQ ID NO: 205 - protein, 207 aa, Thellungiella
MIKSVTLRSFPLPIEFNGKSKFLEPSTSYFPARSFTVVRCSSTRDVPKLELFSRGKFDRILQDPPLIEKAESELSDYCSTLEGDDSYSCWKAYFELKDLEKEKPKVEVENLILQTGGLKSLIGCLHGVALIEKDKKTKNGLESTEESNSKKGSMKLHIHIPDGLPKSQEELEEEEKSLMPDSAFTRLLRTMGTIPAWFSHVPDHETD

SEQ ID NO: 206 - protein, 200 aa, Brassica oleracea, Canola
MIKSVTLRPFPLPIEFHGKPQFVEPSKSCFAVVRCSSTRDVPKLELFSRGKFDRVLQDPPLIEKTENELSDYCSTLEGDASYSCWRAYFELKDLEKEKPKVEVENLILQTGGVKSLIGCLHGLASMEKESKTKNGSEVTEESDSDKMKLHVHVPDGLPKSQEELEEEEKSRMPDSAFTRLLRAKGTIPAWFSHAPDHETD

SEQ ID NO: 207 - protein, 200 aa, Canola
MIKSVTLRPFPLPIEFHGKPQFVEPSKSCFAVVRCSSTRDVPKLELFSRGKFDRVLQDPPLIEKAETELSDYCSTLEGDASYSCWRAYFELKDLEKEKPKVEVENLILQTGGLKSLIGCLHGLASMKKESKTKNGLEVTEETDSDKMKPHVHVPDGLPKSQEELEEEEKSRMPDSAFTRLLRAKGTIPAWFSHAPDHETD

SEQ ID NO: 208 - protein, 200 aa, Brassica rapa
MIKSVTLRPFPLPIEFHGKPQFVEPSKSCFAVVRCSSTRDVPKLELFSRGKFDRVLQDPPLIEKAETELSDYCSTLEGDASYSCWRAYFELKDLEKEKPKVEVENLILQTGGLKLLIGCLHGLASMKKESKTKNGLEVTEETDSDKMKPHVHVPDGLPKSQEELEEEEKSRMPDSAFTRLLRAKGTIPAWFSHAPDHETD

SEQ ID NO: 209 - protein, 200 aa, Raphanus sativus
MIKSVTLRPFPLPIEFHGKPKFVQTSKSCFPVVRCSSTRDVPKLELFSRGQFDRVLQDPPLIEKTETELSDYCCKLEGDDSYSCWRAYFELKDLEKEKPKVEVENLILQTDGVKSLIGCLHGIASMEKESKTKNGLEVREESDSDKMKLHVHVPDGLPKSQQELEEEEKSRMPDSAFTRLLRAKGTIPAWFSHPPDHKTD

SEQ ID NO: 210 - DNA, 1152 bp, Glycine max
catttttctctctttattacattttcattatggtgaccaagatatgatctgttatcaatatatattcaatgacattcacagtcccgagtcctaacctgagttgtgtctcaacttgctcttcttcttcttctctttcaccctccaaattttctcactctctctttatcttcaccttttcagtttaaagcttcagatcacaaccgatccaccattcaccactttctcttcacaagctcaagttactgacaggcaaatctaacaagaaaagtagtctctgaagccgatccagtgccttgtgaatttggaattggtggtgaatttagatctaaaagccatagcaatgtcttttatcggtacccagcaaaagtgcaaggcttgtgagaaaacggtttatcccgttgatcagctttctgctgatggtactgcttatcacaaagcttgcttcagatgctctcactgcaaaggaacattaaagctgagtaactattcctcaatggaaggtgttctttactgtaagcctcactatgagcagctcttcaaggagagtggctccttcagcaagaacttccagtcacctgcaaagctagctgataagacaactcctgagctgacaaggtctcctagtaaagctgcgagcatgttttctggcacacaagaaaagtgtgccacatgtggcaaaactgcttatccattagagaaggtaacagtggaagggcaggcctatcacaaatcatgtttcaagtgttcacatggtggatgtcccataacgccatcgaattatgcagcccttgagggcattttgtattgcaagcaccacttctcccagctttttaaggagaaagggagctataatcatcttactaagtctgcatcagtcaaacgggcagccgcagccacagcagcagcaacaacagctgcctctgttccagaatcttgaatgttggttccttcaattgccttttctttttcaaatacattttggtttgtgaagcaggtgtttgtatgtgtggcctttttggtttttgattgttctctcgtgactttgatcatttctgatatttttacttacacatgcgtggcgtgcaaatcttgtgtggtttattcatataatggacatttagtaaagacgagactaatgagagcgtgatttgc

SEQ ID NO: 211 - DNA, 1172 bp, Glycine max
tcttgtaatctatatagccaaacaaaccaagcagcattataatagaaagaggacacaaagtgaaagagaagggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtgggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaatcctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctgaagcgggcctaatacaatgttcaatgaaatcccgtaccaaagtggacctatatatatatatatatatatgaagcacttcagcgagactatggagcggagtgttgttagcttgaatgtgtctggtgttttttgttttgttcgtatatagattcaacttttaattttaaggagccgatcgatggggcatttgtaatggacaagaagcaataaacttaacctatatagtctggcttgtttattat

SEQ ID NO: 212 - DNA, 2228 bp, Glycine max
taaagaattcgttccattattatggcctcccttgttccttatcttttccaatttccacccttctttctttctctctctccgtttcccctttagacctctctctcacttgaaactccacaaccccattttcctttcctatgaccctattccaaatcaccaattctaattccattcttcaggtgttcaattgaattcgtgatgaagagggatcaccgagatagctgcggcggcggcggcggagggagtgtgaagggtgagtgttcctcaatgccgtcgaacgggaaggcaaatatgtgggaggaacaacaacaacaacaacaggggatggacgagttgctggcggcgttggggtacaaggttcgtgcttccgacatggccgacgtggcacagaagctggagcagttggagatggtcatgggttgtgcccaggaagagggaatttcccacctcgcctccgacaccgtccactacgatcccacggatctttattcctgggtccaaaccatgttaaccgaactcaaccctgaacccaacaacaacaacaatagcctcctcggtccatcttctctcttaatcgacaacaacaccgcccctgttttcaacgacgattccgaatatgacctcagagccattcctggtattgcagcctaccctcctcctcctccacaagacaacaacaacaacaacaacaacctcgacgaaatcgaaacagctaacaacatcaacaagcgtctcaagccatctccagttgaatcagcagactccgcgtctgagcccacgcgcacggtgctgctcgttgaccatcaggaagccggcgtgcgtctggtccacactctcctggcgtgcgcggaggccgtccagcaggagaatctgaagctggccgacgcgctcgtcaagcacgtgggcatactcgcggcttctcaagccggcgccatgaggaaggtggcttcctacttcgcccaagccctcgcgcgtcgtatctacggaatcttcccggaagaaaccctcgactcctccttctccgacgttctccacatgcacttctacgagtcctgcccttacctcaaattcgcgcacttcaccgcgaatcaggctatcctcgaagcatttgccactgctgggagagtccacgtcatcgatttcggcctcagacaagggatgcagtggcctgcactcatgcaagcccttgcattgcggcccggcgggcccccgactttccgtctaaccggaatcggcccgccgcagcccgacaacaccgacgcgctgcagcaagtgggctggaaattagcccaattggcccagaacatcggcgtccagttcgaattccgcggcttcgtttgcaacagcctcgcggatctcgacccgaaaatgctcgagatccgacccggagaagccgtcgctgtcaactcggttttcgagctccatcgtatgctggcccgccccggatccgtcgacaaggtcttggacactgttaagaaaatcaagccgaagattgtcaccatcgtggaacaagaagcgaaccacaacggaccgggttttcttgaccggttcactgaggccttgcattactactccagcctattcgactcgctggagggttcgtcctcttcgaccgggttgggctcaccaaatcaggatctgttaatgtccgagttgtacctggggagacaaatatgcaacgtggtggctaacgagggcgcggaccgggtagagcgtcacgagactttgagtcagtggagggggagattggactcggccgggttcgacccggttcatctcgggtccaacgcgttcaagcaagcgagtatgctacttgctctattcgcaggcggtgacggctatagggttgaggagaataacggctgcctcatgcttggctggcacactcggccactcatcgctacctccgcctggaagcttccctccccgaacgacttgcactgtaaactgtagattaattggctcctggatgggtggtaaataataaaaaatggtttggttgaacttgttcgagtggagtgaatcaatgacccagtgagtcagtgagtcagtgagcgagccagcgaggcagcaagaggataaataaatgagagggtaaaaaaacaaaaaagtaaaaaagaaaaacaaaagactgtaatttgtaattgtgctctcgtaattaccgtttctcctctttagtgtttttttttcctttctctaaattattatataatttgtttaattcttaa

SEQ ID NO: 213 - DNA, 4172 bp, Glycine max
actgtacttaatttctgaagttttaactttaaagttctaatctttgtgctaaactctcctgtctgcttcaaaagattcatacctgaggggagggatttctgctacagtctacattgtgctttaggaagtgtttttggacaacgaatctcttggagctactagcttcccatcatttggtggttgtttagttggggcacttgtggttttgaagaacccctcttttcgtttttgctgtaagtccttcactaagtgtggattgagaagcttgaagacccaactctctcttttgaagactgtgtttgcttgcttcttttctaaattgctgctttcttttagaagaaccaaagaagggcatcttggaattctatttgtacctttttttggtggggtgaagatagttgcttatccttttgaactaaaagggtgaaagctccctttctgtcttcacttagtgtgaactacacagaagtaaacattctagtgtctgtagaagactatgaagccttttagccttttagtgttatctttatatttcttctctgtggtggggcagcttccttctcaggacattttagcattgctggagtttaagaaaggcatcaagcatgaccctactggttatgttctcaattcctggaatgaggaatccattgactttgatggatgcccatcttcatggaatggagttctgtgcaatgctggcaatgttgctggggttgtccttgataacttgggtctctctgctgaccctgacctgagtgtgttttcaaatcttacaaagcttgtgaaactctccatgtccaacaattccatatcaggaacactacctgacaacattgctgatttcaaaagccttgaattcttggatatctccaataacctcttttcctcatccttgccattgggaattggtgagttacggagcttgcagaatctgtcattggctggaaataacttctccggcccaattcctgactctatttcagaaatggcctccatcaagtccctggacttgagccgcaactccttctctggaatgctgccagtgacgttgactaagacgactagtcttgtatctcttaacttgtctcataatggcttcactggaaaagttcccaaaggttttgagctgatccccgctcttgaaaaacttgacttgcatggaaatatgcttgaaggtaatttggatgttgtatttatgcttttatcaagtgccagctatgttgatttaagtgagaacatgctgtcaagttctgattccaagaagaagtttctaccacgaatatctgaaagtattaagcatctgaatctaagccacaacaagcttactgggtcattggctagtggagctgctgaacctgtttttgaaaacttgaaggtgttggacctcagctacaatcagttggatggagaattgcctggatttgattttgtttatgatcttgaagttcttagacttagcaacaacagattttcaggatttattcctaatggcctgctgaaaggagactctttggttttaactgaattggatttgagtgccaacaacctctcagggccactaagtataattacatcaacaacacttcattctcttaatctctcatcaaatgagttcacgggtgatctgccgctgctgactggaagctgtgctgtacttgatctgtcaaacaacaaattagaaggaaacttgaccaggatgttgaaatgggggaatatagaatttcttgatctcagtgggaatcatttgacggggaccatccctgaggaaactcctcaatttttgcgattgagttatttgaacctatcccataattctctaagcagctcccttccaaaagtcttaacacagtatccaaagcttagagtgctcgacattagtttcaaccaattggatggactacttctagctaatctgctcacactgtccacattgcaagagctgcaccttgaaaataatatgatctctggtggcatcaagttttcatcttctgctgaccaatctgatcttcagattcttgatctttctcacaaccagcttaatggctattttcctgatgagtttgggtcattaactggcctgaaagtgctaaatattgctggaaataatttttctggttctcttccaactaccattgctgacatgagttcactagactccctggatatatcagagaatcattttgctggtcctctaccaagtaacatcccaaaggggctccaaaactttaatgcttcacaaaatgatctgtcaggacttgtcccggaagttcttagaaagtttcctagttcttctttctttcctgggaataccaagttacattttccaaatggtcctcctggatcagtcagttcacctgctaaaagttccaagaggaagcatatgaacaccatagttaaagtcataatcatagtgtcatgcgtggttgcactcttcatattaatcttgcttgctgtcttcatacactacatacgtatatcaagatctccacaagaatatgatgcaagtaaggatatccacaggcatcctcaaccaattatctcggctcctgttcgtacgactgataggggtggtgctttggttgtttcagctgaggaccttgtgacctcacgcaaagagtcaccatcggagattatcagctctgacgaaaaaatggcagctgtaacggggttctctccatcaaaacaaagccacttttcatggtcaccagaatctggtgattcacttactggtgaaaatcttgcaagactagatacgagatcgccagatcggttgattggtgagctgcattttctggatgatacgataacattgacacctgaggagctctcaagggccccagctgaagttttgggaagaagtagtcatggtacttcttacaaggcaactctggagaatggtttgttgttgagagtgaagtggttgagagaaggagtggcaaaacagagaaaagaatttgtcaaggagatgaagaaatttgcaaacatcagacatccaaatgttgtaggattgagaggatattattggggtcctacacagcatgaaaagcttatactttcagattacatctcacccggaagtcttgctagttttctttatgatcgaccaggaagaaaaggtccaccactaacttgggcccagaggctcaaaatagcagtcgatgtagcacgtggtctgaactatctccattttgatcgtgctgttcctcacgggaatctcaaagctacaaatgtgttgttagatacaactgatatgaatgcacgtgtcgccgattactgccttcaccgactcatgactcgagctggtaacattgaacagattcttgatgctggggtcttgggttatcgtgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagattgggtaaggttgcgcgtagcagaaggccgaggctcagaatgttttgatgctaccttgatgccagaaatgagcaatccaattgcagaaaagggaatgaaggaggtcctgggaatagtgatgcggtgcattcggtctgtttctgaaaggcctggtatcaagactatttatgaagatctctcttctatataatctgctcatgctaactgtttcaactttgacatattgtgggaattaatgtctcattagtgtcccatgttggttcagagcttggccttttaacatgtttgtattaaccatttttttagctgtaaaaatggggctgcgccaaaagcatatacatggatgttacttgatgggttgtgaccatctaattctgtcttgaaatggtatgtgctatgaatggtcatttctttgcaagtactacacggttgaaggctgtacaagttggtcatgtaaccgttagcacttagcagttatatttttttgttgatttaattgatcttttttagagttgatggccaaagatgttggacatagttctccgcaaactcagctggttttcactttcaggaagttgcgtgccactaatgagtaacagtagctgttactattgtcatgtaatcacaatggttgtggaagccatgatttattaaattcaatctttgcctgtgttgat

SEQ ID NO: 214 - DNA, 1875 bp, Glycine max
acacaacaaccttcttcttcttctcttaaaagttattaagagcttttgcttttctttctgcgcgcttttcccaattaagtagttcttcattttcttcaagtaacaaaaatgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggttccaccgagtacgccagtggttaatgcactgtcaaagcagcgagctatgctggaaaacatcctaagggcttgtgttggattagctcctgagaacaacatgatcctggagtacaagtgaagttcaaagtcttaagagtaatggtttgggatactgtagttgaatgagatcaaaacttaactcatatcccataccctcttttctgttatatatttatggcaaatgtgaaatttaaagatcgttggatctctctatctttgttcctgctgactaatttgagagcaggctatctatgctatgcatgcatgtaaaataatataaagttatcgaagtattttgtgcttaattcatgtt

SEQ ID NO: 215 - DNA, 2181 bp, Glycine max
acaccacaactccaaactttttcctcttgttctcttcttcttcaacacaactagtcataatccagctcatctctctctccctctctctttgttctctctttctctttctccaaaatggctctaaactacccttttttaacctacttcatactactgctagtaaccataacccgtttgatattcactgtgggaaaaactgagcaatggaaagctccgattctaccagagcttgacattgataacatatcccacaaactccatgatgaccctgaaaccattcaaatggcttcaagggactatggccatttaacgcatgaattcccattagctgtgtttcgtccatcttctatagatgacatagtcaccttgataaaatcttcgtacaatagctttgccccttttgacatagctgcgaggggccaaggccactccactcatggacaagccatggctcgtgatgggattgtggtggacatggccagcctaagaaaacaaagaaatggggttgcgattagtgtctctaaggaccctttgatgggtcactatgctgatgttggaggggaacaactctggattgatgtgctacatgccacacttgaatatggacttgcaccagtttcttggactgattatttgtacttgaccgtgggagggacactttctaatgctggaatcagtggccagagcttccgttatggacctcaaatcagcaacgttcatgaaatggatgtcatcactggaaaaggagagttcgtaacatgctcttcacagaagaacttggagttattccacgcggttcttggaggcttgggacaatttggagttatagcaagggcgagaattgctcttgagccagcacccaaaagggttaagtgggtcagactactttatagtgacttttctgcttttaccaaagaccaggaacgattaatctcaatcaatggaaggaaacaaaagaacgcattggattttctggaagggatgctgctaatgaaccaaggccccataaataattggagatcctctttcttccctctatctgaccatcccagaatagcttctttaataactgaacatagcatcctctactgtcttgaagtggctaaatattatgacgaacaaaccgagttaaatgtggacaaggaaattgaagttttgctccaaggactagcctatatccctggatttaattatgagaaaaatgtctcgtacgttgagttcttgaatagggtccgaagtggagagttgaaacttcagtcacaaggactgtgggaagttcctcacccgtggcttaatttgtttataccaaaatctcaaatcttggattttaattcaggagtattcaaagatatagttcttaaaagaaacatctcctctggaccagtcttggtttatcccatgaatagaaacaagtgggacgataggatgtcagcatctataccagacgaggatgttttctacacagttgggtttttgcactcaagtgggtttgatacttggaaggcatatgatgctcaaaacagagaaattttggagttctgtagagatgctggcatcatggtcaagcaatatcttcccaaccacagcacacaagaagattggacaaaccattttggtgctaaatggatgaaattcttagaaagaaaacatcagtttgatccaagaatgattctatcacctgggcaaaaaatcttccacaaaaaattacagccagtgttttaaatattttccctaataaaaaaagtaaaaatgttttgtggtgggactacctcaattagatggctagctagggacaggtgtacatacagtgtgaccaagaccaagatggcttttgtatgctaaagtttgcattgctagctagagaaattaataaggtggggcattaaaggctgcatgagtacttttggcacctattatgctacatattaccttagatacgttaggttgacaaagtcgtactggtaggtacaagaagcacagttgtctctcacactgtctgtcacccaacttgctatatagtgtgtggagaaattcggatcatattgaagatgctgtgagttatagtcctccaatattaaatgtttaacgattctgtctttctcttatataattttgttttgcattatattactttcgcactggtgcaaacatatatatcaatgattataattaatttataca

SEQ ID NO: 216 - DNA, 1419 bp, Glycine max
agccttcctcaaatttcattttgttcctcacccagtcaccaaccccgttgtccggagccaccattttgcgctccggcaatgttcttcccggtggccatcgtcccttaaacccaccacacttcaaagtcatgggtattccatgggacgacgtcgttgtgatccagcaagggaaggatcacaatgagccctgcatcgtcaccgtcaattgccccgacaaggctggtctcggctgtgatctttgcagaatcatcctcgagttcggtctccgcattacccgtgctgatatttccacggatggaagatggtgctacatcgtctattgggttcttgcacatccagcatcgctcaacgttgattgggagagtttgaagactcggctcctttcagcttgcccttcatgtttgctttcctatcacttcaatcagcactccactagtccttcaccgcctccgatttacctgttgaaggtttggtgtgttgatcaaaaaggattgctacatgatattaatgaaatcctgtgcaaccttgaacttattattcagagagtcaaagcgatgccaaccccagatggaagggtgttagacatgttctttatcactgatgggatggaattgcttcacaccaaaaagaggcaagattatgtatgtgaatatctgatggatgctttaggagagaggtgtatctccagtgaacttcagttggctgggcctgaatacggacatttgcaggggttttcttctcttccaccagcttttgctgaagagttatttagttctgagctgttagacaagttgtctttgcatcctctcagccaagatatgacaacactgaagacacctactgttactgtggataactcactgagcccagttcataccctgcttcagatacaatgcgttgatcagaagggcttgtgttatgacattatgaggatttctaaagactctgatattaaggttgcttttggtcgattttcttcaagtgtgaaaggctttcggaatatagacttgtttgtccagcacaacgatgggaaaaagatcatagatcctgaaagccagaaaaccttgtgttcatgcttaaaagaagagatgcttcatccgttgcgggtgacgatagtgaaccggggtccagacacagaacttctggttgctaatcctgtggagctgagtggaaaggggagaccccgtgtattctatgatgttacgttgactttaaaagcgttgggagtaggcattttctcggctgaagttgttagacattcaacacaagaacgtcaatgggaagtgtatagatttttgttggaggaaagccgtgactttccattgaccagaagccaagcaagaactcagattgttgacaaagttagaagaacactgatgggctggtaatttggttcagtatcaaatgaaaaagcacttt

SEQ ID NO: 217 - DNA, 704 bp, Glycine max
gcaccatcactagaacatatagaaaaaccaagtaatactagccaaaatatgtctcccaaatacatgtcccttttcctcctagtaatactagggatggcttttctggccactacttcccttgctgatcgtcgttttctttcggtggaagatggtcatgatcaccatcaccaccacccaccaaaaaaacactggcctccaaccacacaaaatgaaccttcaaacgtagaaaacaaggagaacactgaggtggaggatggtcatgatcatcaccatcactacccacctaaaaaacactggcctcctaccacacaaaatgaaccttcgaaagtagaaaacaaggatggtcactataagcctccccacaagaagcatcctccttcgggaaattaattaatctagtgaagctgctacgtactaccatgcatgcactcttgtgaaaatatattagagtatatggtttaatcaattagagtccaatctcttggctcttgaaataaaggcatgcattaatccgatgttattttcttgtattagtgtggttgtttttgctttggtcactttggctttgtatttggttgaaataaagatgcacatgctacatgtatgcaatcatatatgttatcatttccttaattttctttgcagctttgtcaactagggtgacaaactattatttatgaaatgaattattacgtatttccatc

SEQ ID NO: 218 - DNA, 1186 bp, Glycine max
cctagctacgcctactagttcagatatcaaattagctatggcaacccaaagtgaagaaaatgctacaaaattccttcaagcttatacccagattgatgatcatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagtgggtattgcattgttggaatgacgaggaatgcatgaaaatattgaagaaatgcaaggaggcaatacctagcgacggaaaggttatcatcatggaattagtgatggagcataacaaggaagacaataaattaattgagatgcagctgtgctgtgatatgcttatgatgtcgctttttgcaggaaaagatagaactgagaaagaatgggcacatctgattgcctctgctggtttcagtaactacaagataactcatattttcgatttatatcatatcattgtggtttatccctagttgtgtaacaagtggagcgatgcaagaaattgacataaaactcttgtgttttaattttcatttataattttgttcttattt

SEQ ID NO: 219 - DNA, 2133 bp, Glycine max
ataagacaattaattaagttatttgacacaaaagtcagaagctagggtggtgaagactcaataaaatggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgagaatcatcaatgctgcactcaatgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctgatgtaggaaattatgatcccaaaacggatcaaaataactttaatcttgcggatcctgttgagaggaacacaattggagtgcctactggagggtgggttgctttcagattcagagcagataacccaggagtgtggttcttgcactgccatttcgaggtgcatacaacatgggggttgaagatggcattcttggtggacaatggtaaaggtcctaatgaatcactgctacccccaccaaaagatcttccaaaatgttagacttttcagtcatcgattgaacaacacacagacaagggaaggatacagagaagctaggaaaaacaagagaataaaggggatggtggttatttaataagcaggatgtcccacttgcctttttgagctaatgggagcatttcttcacagtaggttggagtcagcattttggttttctttgaacatacacttttttcttgttaaagcgattcagatcatattcatatgtattgagatcgaccctgcataatttggttatttactgaaataaatctgtcacgtacttcatcgttacatggttgatctttgggtgatttgagaacggtttgcattaccaggatatgatcatgtatcaaaactcaattaaatggtaagcataactgcatta

SEQ ID NO: 220 - DNA, 1421 bp, Glycine max
aggcagattcatgtggagggtatctaactataaatttgagagttgggttttgtcagttcagtactactcttttgagctacttgatcggtggtgtatttggtgtgttgatgttttattaaacttttgtactcttgctttgaaactagttggttaggcaagttttagttttctattttatttcagacttttcaggtgctcatattcttatgatgatcatcaaactgcaaatatagtgagcccattaagctattactgaaatttgttgcagatttgaaattcttctaagatggatacttcttataggactggtggagtcaagtacgagtgcttgctttttgatatggatgacactctttacccattgagcttaggtctcaatttgttttgtcgcaagaacatacaagagtatatgttagaactcttgcatattgaagagagtgaagtgccaaaaatgtgtttggatttgtatagggaatacgggacaactatggcaggattaaaggtccttggttatgagtttgacaatgacgagtttcatgcttacgtgcatggaaggttaccatacgagaaactgaagcctgatccagtattaaggaaccttctgctttccatgcctcagcgtaaaataatattcaccaatgcagatcatgcacatgcagttaaagttctcaacagattgggtttggaagattgttttgagggcatcatatgctttgaaacgcttaatcctcccaaacaaatcaattgcatggatgtaccaaatgataatcatgtgctcacagatttaacagaaaatggatgtttcaattcccacccacaaatcctctgtaaaccatctgtggaagcctttgaagctgctattcggattgctaatgtggatccaaagaaaacaattttctttgatgacagtgttagaaatgttgaaagtgcaaaaataactggacttaacactgttttagtgggccattcagatttggtccctggagctgatcatgccctgaacagcattcataatatcaaagaagcgttacctgaaatttgggagattgaagatggcaaccaacagcaaaagattcaacccccaacagttgaaaccatggtcctagcttaagttttacatcgataaaatgtttttagcagacttatcaagcaaatcaagagtttctacctctgcagtatgtttctatctaaatttacaataagtttgaaattgtctccacggcatggtgatgcttgaatatataaatcttgcaatttggcatcacgaaacggatgtgaaattattaagtgtaaatcgcagaactaaaaatttgagagaaaaacatctactcatctactaaataagggttttcgtacagtttggtaatacaaaatatgggtgttgtatctctcagaacaatggtaattaactaaatgcacta

SEQ ID NO: 221 - DNA, 527 bp, Glycine max
acacacacatatagattttgatagaaattaaattaatggccttcgtcggtgcttccaaaatgatgtcttcatttggtgctcttttggcaatacttttactactcatgtcctctattatgctggcaactgcagccaaaccactcgggcgaaaattactacaacaaggttatggcgggccagttcccgactatggccatcgagatccagttcccgtccgcccaacaggtcgttatcgccggccagatccatttcccgcctatggccatcgagatccagttcccgtccgcccaatacattatggaccaccatgaaaccaataccatcgatccaacggggtgataatggtgtgatttcataggtgtggtaaaaactactagtacttaataaaaatgcatgcgtgtcactactagagtaataatatatatgtcaattgtcatgtattactgttattaattagtcacaaccacttagtggccagacctgtattaattgcagccaataaaattcccattatcgcttgtcccttt

SEQ ID NO: 222 - DNA, 1778 bp, Glycine max
agtatatctccattggtgagtagctataaaatagttgggagtgggtgagagtgattcattctctctaactgagaccatcaagaaattaatggaggcatcacccagtactctggattggagaggcagaccatccaaccctgccaaacacggtggaatgattccggctgcttttgttcttgggttgcaagcatttgagataatggcaatagcggcagtgggaaacaatctgataacttatgtggccaatgacatgcacttccctttgtccaaggctgccaacctagtcactaactttgttgggaccatctttctcctctctctcctcggcggctatctatcagactcttaccttggcagcttctggaccatgctcctctttggtttcgtcgaactttctggtttcatactgctatcagtccaagctcatgttcctcaattgaagccacctccatgcaatgtgaacgatggagaacagtgcgtagaagcaaagggcatgaaggccatgatattctttgtagcactctacttggtggcattagggagtgggtgtgtgaagccaaacatgcttgcttatggaggagaccagttcgagcaaaacgacccaaagcagttaaagaagctctcaacctacttcaatgccgcatattttgcattctctgtgggacaacttgtgagcctaaccattcttgtttgggtgcaaactcattcaggaatggacgttggcttcggggtatccgcagctgtaatggcaatgggattgataagcttgatatgtggcactctatattacagaaacaagcccccacaaggaagtattttaactcccgtggctcaggttcttgtcgctgcattttccaaaagaaaccttccatcttccccatcatccatgatcagagtggaacaagttgagcaagtgaagatattgctatctgttattccgatattctcgtgcaccatcgttttcaacaccatcttagcacaacttcagacattctcagtccaacaagggagagcaatggacacccatctcaccaaatcctttaatatccctcccgcctcccttcagtccattccttacattttgctcatctttttagttcctctctatgacaccttctttgtcccatttgccagaaaattcaccggccatgagtctggaatctcacctttgcgccgaataggctttggtctttttctggctaccttttctatggttgcagctgctctgttggagaaaaagagaagggacgcagctgtgaaccatcacaaagttttgtccatcttttggataaccccacaatacttgatatttggcttgtcagagatgttcacagccattggcctccttgagttcttttataaacagtccttgaaagggatgcaagcattctttacagccatcacatattgctcttactcatttggcttttacttgagcacacttttggtttctttggtcaataagatcacttcaacttcttcttcttcagctgctggctggcttcacaacaacgaccttaaccaggacaggcttgatcttttctattggttactggctgtcttaagcttcctcaacttcctcaactatctcttttggtccagacgctattctcatgctccttccgcactaccccaacctaataatgccaaggaaatcaacccctactcacaactacatgatcaccatcacaataatattattccatagatatatatatatatatatatatactcttttcaaaatattaattattttacagttactgtaaagaattata

SEQ ID NO: 223 - DNA, 1335 bp, Glycine max
caaagcctaactttcactttcacacgtcaaagaaacaaagccattatcattaagattctcgttcggctcgggatggctgcccgctgaaccctcggaaacacgcattgcggcggtcatgagagggagctgctggtggaaccgtcggacagagcagcgcttccgcctactcgcgatctccaccgttaaatcactcaagatcaagcttctcctctgttgctgcgtcgccttcacgcttctcgcgttttccacaagcgcttcttccttcgtcctatggatcaacaaccaaacgccgcctccacctcctcgcttccccgattccaggaaagggtattctatagtaatgaacacatggaagagatatgatcttctaaagcagtccatcaagcattattcatcgtgtcctcgacttgaatcagtacatatcgtgtggagtgaacctgatcctccgtcagataatcttttaaaatttctgcaccacgttgtaaagtccaagtctaaagatggaagatatgtgaaattgaggtttgatatcaacaaggaagacagtttgaacaatagatttaaagaaattaaggatttggagacagatgctgtcttttctattgatgatgatgtcatatttccttgctctacggtggaatttgcatttgatgtttggcaaagtgcacctgatacaatggttggatttgtacctcgtgtccattgggtggattcaatggaaggtaatgacaacaaatttatatatggcggatggtggtctgtgtggtggacaggtacatatagcatggtgctttccaaggcagcattctttcacaaaaagtatttcaatatctacacaaatgaaatgccatcatcaattagagaatatgtaaccaagaacaggaattgtgaagatattgcaatgtctttccttgttgcaaatgctactggtgcaccccccatatgggttaaaggtaaaatattcgagattggatcgactggaatcagtagtttgggaggtcacagtgaaagaagaacagaatgcgtcaacagatttgctgccgtgtatgggcggatgcccttggtatctacttcagttaaggctgttgatagccgcaatatctggttttggtgacgctggaattttgattttctttgcatttctagtttctagaaattccactaccgtccttttagtagctagttgagttactcaattcacgttagtcacagctgtacaatatattggatcttatacacaattcatgcgttttgtcgctaattgatcaaactccttgggttgatttcttgtattattcatatgtaatacaaggcagcatcctgtggtgctttttt

SEQ ID NO: 224 - DNA, 597 bp, Glycine max
atgtcttttatcggtacccagcaaaagtgcaaggcttgtgagaaaacggtttatcccgttgatcagctttctgctgatggtactgcttatcacaaagcttgcttcagatgctctcactgcaaaggaacattaaagctgagtaactattcctcaatggaaggtgttctttactgtaagcctcactatgagcagctcttcaaggagagtggctccttcagcaagaacttccagtcacctgcaaagctagctgataagacaactcctgagctgacaaggtctcctagtaaagctgcgagcatgttttctggcacacaagaaaagtgtgccacatgtggcaaaactgcttatccattagagaaggtaacagtggaagggcaggcctatcacaaatcatgtttcaagtgttcacatggtggatgtcccataacgccatcgaattatgcagcccttgagggcattttgtattgcaagcaccacttctcccagctttttaaggagaaagggagctataatcatcttactaagtctgcatcagtcaaacgggcagccgcagccacagcagcagcaacaacagctgcctctgttccagaatcttga

SEQ ID NO: 225 - DNA, 597 bp, Glycine max
atgtcttttatcggtacccagcaaaagtgcaaggcttgtgagaaaacggtttatcccgttgatcagctttctgctgatggtactgcttatcacaaagcttgcttcagatgctctcactgcaaaggaacattaaagctgagcaactattcctcaatggaaggtgttctttactgtaagcctcactatgagcagctcttcaaggagagtggctccttcagcaagaacttccagtcacctgcaaagctagctgataagacaactcctgagctgacaaggtctcctagtaaagctgcgagcatgttttctggcacacaagaaaagtgtgccacatgtggcaaaactgcttatccattagagaaggtaacagtggaagggcaggcctatcacaaatcatgtttcaagtgttcacatggtggatgtcccataacgccatcgaattatgcagcccttgagggcattttgtattgcaagcaccacttctcccagctttttaaggagaaagggagctataatcatcttactaagtctgcatcagtcaaacgggcagccgcagccacagcagcagcaacaacagctgcctctgttccagaatcttga

SEQ ID NO: 226 - DNA, 744 bp, Glycine max
atggcaactatgctgacaaaggagcatggtctgaacctcaaggagaccgagctttgcctcggtttgcctggtgggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaatcctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctga

SEQ ID NO: 227 - DNA, 729 bp, Glycine max
atggcaactatgctgacaaaggagcatggtctgaacctcaaggagaccgagctttgcctcggtttgcctggtgggggaggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaattctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctga

SEQ ID NO: 228 - DNA, 1755 bp, Glycine max
atgaagagggatcaccgagatagctgcggcggcggcggcggagggagtgtgaagggtgagtgttcctcaatgccgtcgaacgggaaggcaaatatgtgggaggaacaacaacaacaacaacaggggatggacgagttgctggcggcgttggggtacaaggttcgtgcttccgacatggccgacgtggcacagaagctggagcagttggagatggtcatgggttgtgcccaggaagagggaatttcccacctcgcctccgacaccgtccactacgatcccacggatctttattcctgggtccaaaccatgttaaccgaactcaaccctgaacccaacaacaacaacaatagcctcctcggtccatcttctctcttaatcgacaacaacaccgcccctgttttcaacgacgattccgaatatgacctcagagccattcctggtattgcagcctaccctcctcctcctccacaagacaacaacaacaacaacaacaacctcgacgaaatcgaaacagctaacaacatcaacaagcgtctcaagccatctccagttgaatcagcagactccgcgtctgagcccacgcgcacggtgctgctcgttgaccatcaggaagccggcgtgcgtctggtccacactctcctggcgtgcgcggaggccgtccagcaggagaatctgaagctggccgacgcgctcgtcaagcacgtgggcatactcgcggcttctcaagccggcgccatgaggaaggtggcttcctacttcgcccaagccctcgcgcgtcgtatctacggaatcttcccggaagaaaccctcgactcctccttctccgacgttctccacatgcacttctacgagtcctgcccttacctcaaattcgcgcacttcaccgcgaatcaggctatcctcgaagcatttgccactgctgggagagtccacgtcatcgatttcggcctcagacaagggatgcagtggcctgcactcatgcaagcccttgcattgcggcccggcgggcccccgactttccgtctaaccggaatcggcccgccgcagcccgacaacaccgacgcgctgcagcaagtgggctggaaattagcccaattggcccagaacatcggcgtccagttcgaattccgcggcttcgtttgcaacagcctcgcggatctcgacccgaaaatgctcgagatccgacccggagaagccgtcgctgtcaactcggttttcgagctccatcgtatgctggcccgccccggatccgtcgacaaggtcttggacactgttaagaaaatcaagccgaagattgtcaccatcgtggaacaagaagcgaaccacaacggaccgggttttcttgaccggttcactgaggccttgcattactactccagcctattcgactcgctggagggttcgtcctcttcgaccgggttgggctcaccaaatcaggatctgttaatgtccgagttgtacctggggagacaaatatgcaacgtggtggctaacgagggcgcggaccgggtagagcgtcacgagactttgagtcagtggagggggagattggactcggccgggttcgacccggttcatctcgggtccaacgcgttcaagcaagcgagtatgctacttgctctattcgcaggcggtgacggctatagggttgaggagaataacggctgcctcatgcttggctggcacactcggccactcatcgctacctccgcctggaagcttccctccccgaacgacttgcactgtaaactgtag

SEQ ID NO: 229 - DNA, 3189 bp, Glycine max
atgaagccttttagccttttagtgttatctttatatttcttctctgtggtggggcagcttccttctcaggacattttagcattgctggagtttaagaaaggcatcaagcatgaccctactggttatgttctcaattcctggaatgaggaatccattgactttgatggatgcccatcttcatggaatggagttctgtgcaatgctggcaatgttgctggggttgtccttgataacttgggtctctctgctgaccctgacctgagtgtgttttcaaatcttacaaagcttgtgaaactctccatgtccaacaattccatatcaggaacactacctgacaacattgctgatttcaaaagccttgaattcttggatatctccaataacctcttttcctcatccttgccattgggaattggtgagttacggagcttgcagaatctgtcattggctggaaataacttctccggcccaattcctgactctatttcagaaatggcctccatcaagtccctggacttgagccgcaactccttctctggaatgctgccagtgacgttgactaagacgactagtcttgtatctcttaacttgtctcataatggcttcactggaaaagttcccaaaggttttgagctgatccccgctcttgaaaaacttgacttgcatggaaatatgcttgaaggtaatttggatgttgtatttatgcttttatcaagtgccagctatgttgatttaagtgagaacatgctgtcaagttctgattccaagaagaagtttctaccacgaatatctgaaagtattaagcatctgaatctaagccacaacaagcttactgggtcattggctagtggagctgctgaacctgtttttgaaaacttgaaggtgttggacctcagctacaatcagttggatggagaattgcctggatttgattttgtttatgatcttgaagttcttagacttagcaacaacagattttcaggatttattcctaatggcctgctgaaaggagactctttggttttaactgaattggatttgagtgccaacaacctctcagggccactaagtataattacatcaacaacacttcattctcttaatctctcatcaaatgagttcacgggtgatctgccgctgctgactggaagctgtgctgtacttgatctgtcaaacaacaaattagaaggaaacttgaccaggatgttgaaatgggggaatatagaatttcttgatctcagtgggaatcatttgacggggaccatccctgaggaaactcctcaatttttgcgattgagttatttgaacctatcccataattctctaagcagctcccttccaaaagtcttaacacagtatccaaagcttagagtgctcgacattagtttcaaccaattggatggactacttctagctaatctgctcacactgtccacattgcaagagctgcaccttgaaaataatatgatctctggtggcatcaagttttcatcttctgctgaccaatctgatcttcagattcttgatctttctcacaaccagcttaatggctattttcctgatgagtttgggtcattaactggcctgaaagtgctaaatattgctggaaataatttttctggttctcttccaactaccattgctgacatgagttcactagactccctggatatatcagagaatcattttgctggtcctctaccaagtaacatcccaaaggggctccaaaactttaatgcttcacaaaatgatctgtcaggacttgtcccggaagttcttagaaagtttcctagttcttctttctttcctgggaataccaagttacattttccaaatggtcctcctggatcagtcagttcacctgctaaaagttccaagaggaagcatatgaacaccatagttaaagtcataatcatagtgtcatgcgtggttgcactcttcatattaatcttgcttgctgtcttcatacactacatacgtatatcaagatctccacaagaatatgatgcaagtaaggatatccacaggcatcctcaaccaattatctcggctcctgttcgtacgactgataggggtggtgctttggttgtttcagctgaggaccttgtgacctcacgcaaagagtcaccatcggagattatcagctctgacgaaaaaatggcagctgtaacggggttctctccatcaaaacaaagccacttttcatggtcaccagaatctggtgattcacttactggtgaaaatcttgcaagactagatacgagatcgccagatcggttgattggtgagctgcattttctggatgatacgataacattgacacctgaggagctctcaagggccccagctgaagttttgggaagaagtagtcatggtacttcttacaaggcaactctggagaatggtttgttgttgagagtgaagtggttgagagaaggagtggcaaaacagagaaaagaatttgtcaaggagatgaagaaatttgcaaacatcagacatccaaatgttgtaggattgagaggatattattggggtcctacacagcatgaaaagcttatactttcagattacatctcacccggaagtcttgctagttttctttatgatcgaccaggaagaaaaggtccaccactaacttgggcccagaggctcaaaatagcagtcgatgtagcacgtggtctgaactatctccattttgatcgtgctgttcctcacgggaatctcaaagctacaaatgtgttgttagatacaactgatatgaatgcacgtgtcgccgattactgccttcaccgactcatgactcgagctggtaacattgaacagattcttgatgctggggtcttgggttatcgtgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagattgggtaaggttgcgcgtagcagaaggccgaggctcagaatgttttgatgctaccttgatgccagaaatgagcaatccaattgcagaaaagggaatgaaggaggtcctgggaatagtgatgcggtgcattcggtctgtttctgaaaggcctggtatcaagactatttatgaagatctctcttctatataa

SEQ ID NO: 230 - DNA, 1533 bp, Glycine max
atgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggttccaccgagtacgccagtggttaatgcactgtcaaagcagcgagctatgctggaaaacatcctaagggcttgtgttggattagctcctgagaacaacatgatcctggagtacaagtga

SEQ ID NO: 231 - DNA, 1608 bp, Glycine max
atggctctaaactacccttttttaacctacttcatactactgctagtaaccataacccgtttgatattcactgtgggaaaaactgagcaatggaaagctccgattctaccagagcttgacattgataacatatcccacaaactccatgatgaccctgaaaccattcaaatggcttcaagggactatggccatttaacgcatgaattcccattagctgtgtttcgtccatcttctatagatgacatagtcaccttgataaaatcttcgtacaatagctttgccccttttgacatagctgcgaggggccaaggccactccactcatggacaagccatggctcgtgatgggattgtggtggacatggccagcctaagaaaacaaagaaatggggttgcgattagtgtctctaaggaccctttgatgggtcactatgctgatgttggaggggaacaactctggattgatgtgctacatgccacacttgaatatggacttgcaccagtttcttggactgattatttgtacttgaccgtgggagggacactttctaatgctggaatcagtggccagagcttccgttatggacctcaaatcagcaacgttcatgaaatggatgtcatcactggaaaaggagagttcgtaacatgctcttcacagaagaacttggagttattccacgcggttcttggaggcttgggacaatttggagttatagcaagggcgagaattgctcttgagccagcacccaaaagggttaagtgggtcagactactttatagtgacttttctgcttttaccaaagaccaggaacgattaatctcaatcaatggaaggaaacaaaagaacgcattggattttctggaagggatgctgctaatgaaccaaggccccataaataattggagatcctctttcttccctctatctgaccatcccagaatagcttctttaataactgaacatagcatcctctactgtcttgaagtggctaaatattatgacgaacaaaccgagttaaatgtggacaaggaaattgaagttttgctccaaggactagcctatatccctggatttaattatgagaaaaatgtctcgtacgttgagttcttgaatagggtccgaagtggagagttgaaacttcagtcacaaggactgtgggaagttcctcacccgtggcttaatttgtttataccaaaatctcaaatcttggattttaattcaggagtattcaaagatatagttcttaaaagaaacatctcctctggaccagtcttggtttatcccatgaatagaaacaagtgggacgataggatgtcagcatctataccagacgaggatgttttctacacagttgggtttttgcactcaagtgggtttgatacttggaaggcatatgatgctcaaaacagagaaattttggagttctgtagagatgctggcatcatggtcaagcaatatcttcccaaccacagcacacaagaagattggacaaaccattttggtgctaaatggatgaaattcttagaaagaaaacatcagtttgatccaagaatgattctatcacctgggcaaaaaatcttccacaaaaaattacagccagtgttttaa

SEQ ID NO: 232 - DNA, 1260 bp, Glycine max
atgggtattccatgggacgacgtcgttgtgatccagcaagggaaggatcacaatgagccctgcatcgtcaccgtcaattgccccgacaaggctggtctcggctgtgatctttgcagaatcatcctcgagttcggtctccgcattacccgtgctgatatttccacggatggaagatggtgctacatcgtctattgggttcttgcacatccagcatcgctcaacgttgattgggagagtttgaagactcggctcctttcagcttgcccttcatgtttgctttcctatcacttcaatcagcactccactagtccttcaccgcctccgatttacctgttgaaggtttggtgtgttgatcaaaaaggattgctacatgatattaatgaaatcctgtgcaaccttgaacttattattcagagagtcaaagcgatgccaaccccagatggaagggtgttagacatgttctttatcactgatgggatggaattgcttcacaccaaaaagaggcaagattatgtatgtgaatatctgatggatgctttaggagagaggtgtatctccagtgaacttcagttggctgggcctgaatacggacatttgcaggggttttcttctcttccaccagcttttgctgaagagttatttagttctgagctgttagacaagttgtctttgcatcctctcagccaagatatgacaacactgaagacacctactgttactgtggataactcactgagcccagttcataccctgcttcagatacaatgcgttgatcagaagggcttgtgttatgacattatgaggatttctaaagactctgatattaaggttgcttttggtcgattttcttcaagtgtgaaaggctttcggaatatagacttgtttgtccagcacaacgatgggaaaaagatcatagatcctgaaagccagaaaaccttgtgttcatgcttaaaagaagagatgcttcatccgttgcgggtgacgatagtgaaccggggtccagacacagaacttctggttgctaatcctgtggagctgagtggaaaggggagaccccgtgtattctatgatgttacgttgactttaaaagcgttgggagtaggcattttctcggctgaagttgttagacattcaacacaagaacgtcaatgggaagtgtatagatttttgttggaggaaagccgtgactttccattgaccagaagccaagcaagaactcagattgttgacaaagttagaagaacactgatgggctggtaa

SEQ ID NO: 233 - DNA, 342 bp, Glycine max
atgtctcccaaatacatgtcccttttcctcctagtaatactagggatggcttttctggccactacttcccttgctgatcgtcgttttctttcggtggaagatggtcatgatcaccatcaccaccacccaccaaaaaaacactggcctccaaccacacaaaatgaaccttcaaacgtagaaaacaaggagaacactgaggtggaggatggtcatgatcatcaccatcactacccacctaaaaaacactggcctcctaccacacaaaatgaaccttcgaaagtagaaaacaaggatggtcactataagcctccccacaagaagcatcctccttcgggaaattaa

SEQ ID NO: 234 - DNA, 1068 bp, Glycine max
atggcaacccaaagtgaagaaaatgctacaaaattccttcaagcttatacccagattgatgatcatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagtgggtattgcattgttggaatgacgaggaatgcatgaaaatattgaagaaatgcaaggaggcaatacctagcgacggaaaggttatcatcatggaattagtgatggagcataacaaggaagacaataaattaattgagatgcagctgtgctgtgatatgcttatgatgtcgctttttgcaggaaaagatagaactgagaaagaatgggcacatctgattgcctctgctggtttcagtaactacaagataactcatattttcgatttatatcatatcattgtggtttatccctag

SEQ ID NO: 235 - DNA, 1068 bp, Glycine max
atggcaacccaaagtgaagaaaatgctacaaaattccttcaagcttatacccagattgatgatcatagtttgggattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactcttgactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagtgggtattgcattgttggaatgacgaggaatgcatgaaaatattgaagaaatgcaaggaggcaatacctagcgacggaaaggttatcatcatggaattagtgatggagcataacaaggaagacaataaattaattgagatgcagctgtgctgtgatatgcttatgatgtcgctttttgcaggaaaagatagaactgagaaagaatgggcacatctgattgcctctgctggtttcagtaactacaagataactcatattttcgatttatatcatatcattgtggtttatccctag

SEQ ID NO: 236 - DNA, 1683 bp, Glycine max
atggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgagaatcatcaatgctgcactcaatgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctgatgtaggaaattatgatcccaaaacggatcaaaataactttaatcttgcggatcctgttgagaggaacacaattggagtgcctactggagggtgggttgctttcagattcagagcagataacccaggagtgtggttcttgcactgccatttcgaggtgcatacaacatgggggttgaagatggcattcttggtggacaatggtaaaggtcctaatgaatcactgctacccccaccaaaagatcttccaaaatgttag

SEQ ID NO: 237 - DNA, 1683 bp, Glycine max
atggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgagaatcatcaatgctgcactcaatgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctggtgtaggaaattatgatcccaaaacggatcaaaataactttaatcttgcggatcctgttgagaggaacacaattggagtgcctactggagggtgggttgctttcagattcagagcagataacccaggagtgtggttcttgcactgccatttcgaggtgcatacaacatgggggttgaagatggcattcttggtggacaatggtaaaggtcctaatgaatcactgctacccccaccaaaagatcttccaaaatgttag

SEQ ID NO: 238 - DNA, 825 bp, Glycine max
atggatacttcttataggactggtggagtcaagtacgagtgcttgctttttgatatggatgacactctttacccattgagcttaggtctcaatttgttttgtcgcaagaacatacaagagtatatgttagaactcttgcatattgaagagagtgaagtgccaaaaatgtgtttggatttgtatagggaatacgggacaactatggcaggattaaaggtccttggttatgagtttgacaatgacgagtttcatgcttacgtgcatggaaggttaccatacgagaaactgaagcctgatccagtattaaggaaccttctgctttccatgcctcagcgtaaaataatattcaccaatgcagatcatgcacatgcagttaaagttctcaacagattgggtttggaagattgttttgagggcatcatatgctttgaaacgcttaatcctcccaaacaaatcaattgcatggatgtaccaaatgataatcatgtgctcacagatttaacagaaaatggatgtttcaattcccacccacaaatcctctgtaaaccatctgtggaagcctttgaagctgctattcggattgctaatgtggatccaaagaaaacaattttctttgatgacagtgttagaaatgttgaaagtgcaaaaataactggacttaacactgttttagtgggccattcagatttggtccctggagctgatcatgccctgaacagcattcataatatcaaagaagcgttacctgaaatttgggagattgaagatggcaaccaacagcaaaagattcaacccccaacagttgaaaccatggtcctagcttaa

SEQ ID NO: 239 - DNA, 276 bp, Glycine max
atggccttcgtcggtgcttccaaaatgatgtcttcatttggtgctcttttggcaatacttttactactcatgtcctctattatgctggcaactgcagccaaaccactcgggcgaaaattactacaacaaggttatggcgggccagttcccgactatggccatcgagatccagttcccgtccgcccaacaggtcgttatcgccggccagatccatttcccgcctatggccatcgagatccagttcccgtccgcccaatacattatggaccaccatga

SEQ ID NO: 240 - DNA, 1620 bp, Glycine max
atggaggcatcacccagtactctggattggagaggcagaccatccaaccctgccaaacacggtggaatgattccggctgcttttgttcttgggttgcaagcatttgagataatggcaatagcggcagtgggaaacaatctgataacttatgtggccaatgacatgcacttccctttgtccaaggctgccaacctagtcactaactttgttgggaccatctttctcctctctctcctcggcggctatctatcagactcttaccttggcagcttctggaccatgctcctctttggtttcgtcgaactttctggtttcatactgctatcagtccaagctcatgttcctcaattgaagccacctccatgcaatgtgaacgatggagaacagtgcgtagaagcaaagggcatgaaggccatgatattctttgtagcactctacttggtggcattagggagtgggtgtgtgaagccaaacatgcttgcttatggaggagaccagttcgagcaaaacgacccaaagcagttaaagaagctctcaacctacttcaatgccgcatattttgcattctctgtgggacaacttgtgagcctaaccattcttgtttgggtgcaaactcattcaggaatggacgttggcttcggggtatccgcagctgtaatggcaatgggattgataagcttgatatgtggcactctatattacagaaacaagcccccacaaggaagtattttaactcccgtggctcaggttcttgtcgctgcattttccaaaagaaaccttccatcttccccatcatccatgatcagagtggaacaagttgagcaagtgaagatattgctatctgttattccgatattctcgtgcaccatcgttttcaacaccatcttagcacaacttcagacattctcagtccaacaagggagagcaatggacacccatctcaccaaatcctttaatatccctcccgcctcccttcagtccattccttacattttgctcatctttttagttcctctctatgacaccttctttgtcccatttgccagaaaattcaccggccatgagtctggaatctcacctttgcgccgaataggctttggtctttttctggctaccttttctatggttgcagctgctctgttggagaaaaagagaagggacgcagctgtgaaccatcacaaagttttgtccatcttttggataaccccacaatacttgatatttggcttgtcagagatgttcacagccattggcctccttgagttcttttataaacagtccttgaaagggatgcaagcattctttacagccatcacatattgctcttactcatttggcttttacttgagcacacttttggtttctttggtcaataagatcacttcaacttcttcttcttcagctgctggctggcttcacaacaacgaccttaaccaggacaggcttgatcttttctattggttactggctgtcttaagcttcctcaacttcctcaactatctcttttggtccagacgctattctcatgctccttccgcactaccccaacctaataatgccaaggaaatcaacccctactcacaactacatgatcaccatcacaataatattattccatag

SEQ ID NO: 241 - DNA, 999 bp, Glycine max
atgagagggagctgctggtggaaccgtcggacagagcagcgcttccgcctactcgcgatctccaccgttaaatcactcaagatcaagcttctcctctgttgctgcgtcgccttcacgcttctcgcgttttccacaagcgcttcttccttcgtcctatggatcaacaaccaaacgccgcctccacctcctcgcttccccgattccaggaaagggtattctatagtaatgaacacatggaagagatatgatcttctaaagcagtccatcaagcattattcatcgtgtcctcgacttgaatcagtacatatcgtgtggagtgaacctgatcctccgtcagataatcttttaaaatttctgcaccacgttgtaaagtccaagtctaaagatggaagatatgtgaaattgaggtttgatatcaacaaggaagacagtttgaacaatagatttaaagaaattaaggatttggagacagatgctgtcttttctattgatgatgatgtcatatttccttgctctacggtggaatttgcatttgatgtttggcaaagtgcacctgatacaatggttggatttgtacctcgtgtccattgggtggattcaatggaaggtaatgacaacaaatttatatatggcggatggtggtctgtgtggtggacaggtacatatagcatggtgctttccaaggcagcattctttcacaaaaagtatttcaatatctacacaaatgaaatgccatcatcaattagagaatatgtaaccaagaacaggaattgtgaagatattgcaatgtctttccttgttgcaaatgctactggtgcaccccccatatgggttaaaggtaaaatattcgagattggatcgactggaatcagtagtttgggaggtcacagtgaaagaagaacagaatgcgtcaacagatttgctgccgtgtatgggcggatgcccttggtatctacttcagttaaggctgttgatagccgcaatatctggttttggtga

SEQ ID NO: 242 - DNA, 1005 bp, Glycine max
atgagagggagctgctggtgctggaaccgtcggacagagcagcggttccgcctcctcgcgatctccaccgttaaatcactcaagatcaagcttctcctcttttgctgcgtcgccttcacgcttctcgccttttccaccagcgcttcttccttcgtcctatggatcaacaaccaaacgccgccgcctccgccacctcgcttccccgattccgggaaagggtattctatagtaatgaacacatggaagagatatgatcttctaaagcagtccatcaagcattattcatcatgtcctcgacttgaatcagtacatattgtgtggagtgaacctgatcctccatcggatattcttttaaaatttctgcaccacgttgtaaagtccaagtctaaagatggaagatatgtgaaattgaggtttgatatcaacaaggaagacagtttgaacaatagatttaaagaaattaaggatttggagacagatgctgtcttttctattgatgatgatgttatatttccttgctctacggtggaatttgcatttgatgtttggcaaagtgcacctgatacaatggttggatttgtacctcgtgtccattgggtggattcattggaaggtaatgacagcaaatttatatatggcggatggtggtctgtgtggtggacgggtacatatagcatggtgctttccaaggcagcattctttcacaaaaagtatttcaatatctacacaaatgagatgccatcatcaattagagaatatgtaaccaagaacaggaattgtgaagatattgcaatgtctttccttgttgcaaatgctaccggtgcaccccccatatgggttaaaggtaaaatattagagattggatcgactggaatcagtagtttgggaggtcacagtgaaagaagaacagaatgcgtcaacagatttgttgccgcgtatgggcggatgcccttggtatctacttcagttaaggctgttgatagccgcaatatctggttttggtga

SEQ ID NO: 243 - protein, 198 aa, Glycine max
MSFIGTQQKCKACEKTVYPVDQLSADGTAYHKACFRCSHCKGTLKLSNYSSMEGVLYCKPHYEQLFKESGSFSKNFQSPAKLADKTTPELTRSPSKAASMFSGTQEKCATCGKTAYPLEKVTVEGQAYHKSCFKCSHGGCPITPSNYAALEGILYCKHHFSQLFKEKGSYNHLTKSASVKRAAAATAAATTAASVPES

SEQ ID NO: 244 - protein, 247 aa, Glycine max
MATMLTKEHGLNLKETELCLGLPGGGGGGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANPGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 245 - protein, 242 aa, Glycine max
MATMLTKEHGLNLKETELCLGLPGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANSGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 246 - protein, 584 aa, Glycine max
MKRDHRDSCGGGGGGSVKGECSSMPSNGKANMWEEQQQQQQGMDELLAALGYKVRASDMADVAQKLEQLEMVMGCAQEEGISHLASDTVHYDPTDLYSWVQTMLTELNPEPNNNNNSLLGPSSLLIDNNTAPVFNDDSEYDLRAIPGIAAYPPPPPQDNNNNNNNLDEIETANNINKRLKPSPVESADSASEPTRTVLLVDHQEAGVRLVHTLLACAEAVQQENLKLADALVKHVGILAASQAGAMRKVASYFAQALARRIYGIFPEETLDSSFSDVLHMHFYESCPYLKFAHFTANQAILEAFATAGRVHVIDFGLRQGMQWPALMQALALRPGGPPTFRLTGIGPPQPDNTDALQQVGWKLAQLAQNIGVQFEFRGFVCNSLADLDPKMLEIRPGEAVAVNSVFELHRMLARPGSVDKVLDTVKKIKPKIVTIVEQEANHNGPGFLDRFTEALHYYSSLFDSLEGSSSSTGLGSPNQDLLMSELYLGRQICNVVANEGADRVERHETLSQWRGRLDSAGFDPVHLGSNAFKQASMLLALFAGGDGYRVEENNGCLMLGWHTRPLIATSAWKLPSPNDLHCKL

SEQ ID NO: 247 - protein, 1062 aa, Glycine max
MKPFSLLVLSLYFFSVVGQLPSQDILALLEFKKGIKHDPTGYVLNSWNEESIDFDGCPSSWNGVLCNAGNVAGVVLDNLGLSADPDLSVFSNLTKLVKLSMSNNSISGTLPDNIADFKSLEFLDISNNLFSSSLPLGIGELRSLQNLSLAGNNFSGPIPDSISEMASIKSLDLSRNSFSGMLPVTLTKTTSLVSLNLSHNGFTGKVPKGFELIPALEKLDLHGNMLEGNLDVVFMLLSSASYVDLSENMLSSSDSKKKFLPRISESIKHLNLSHNKLTGSLASGAAEPVFENLKVLDLSYNQLDGELPGFDFVYDLEVLRLSNNRFSGFIPNGLLKGDSLVLTELDLSANNLSGPLSIITSTTLHSLNLSSNEFTGDLPLLTGSCAVLDLSNNKLEGNLTRMLKWGNIEFLDLSGNHLTGTIPEETPQFLRLSYLNLSHNSLSSSLPKVLTQYPKLRVLDISFNQLDGLLLANLLTLSTLQELHLENNMISGGIKFSSSADQSDLQILDLSHNQLNGYFPDEFGSLTGLKVLNIAGNNFSGSLPTTIADMSSLDSLDISENHFAGPLPSNIPKGLQNFNASQNDLSGLVPEVLRKFPSSSFFPGNTKLHFPNGPPGSVSSPAKSSKRKHMNTIVKVIIIVSCVVALFILILLAVFIHYIRISRSPQEYDASKDIHRHPQPIISAPVRTTDRGGALVVSAEDLVTSRKESPSEIISSDEKMAAVTGFSPSKQSHFSWSPESGDSLTGENLARLDTRSPDRLIGELHFLDDTITLTPEELSRAPAEVLGRSSHGTSYKATLENGLLLRVKWLREGVAKQRKEFVKEMKKFANIRHPNVVGLRGYYWGPTQHEKLILSDYISPGSLASFLYDRPGRKGPPLTWAQRLKIAVDVARGLNYLHFDRAVPHGNLKATNVLLDTTDMNARVADYCLHRLMTRAGNIEQILDAGVLGYRAPELAASKKPMPSFKSDVYAFGVILLELLTGRCAGDVISSEEGGVDLTDWVRLRVAEGRGSECFDATLMPEMSNPIAEKGMKEVLGIVMRCIRSVSERPGIKTIYEDLSSI

SEQ ID NO: 248 - protein, 510 aa, Glycine max
MFIESFKVESPNVKYTETEIQSVYNYETTELVHENNNGTYQWVVKPKTVKYEFKTNTHVPKLGVMLVGWGGNNGSTLTGGVIANREGISWATKDKIQQANYFGSLTQASAIRVGSFQGEEIYAPFKSLLPMVNPDDVVFGGWDISNLNLADAMARAKVFDIDLQKQLRPYMESMVPLPGIYDPDFIAANQGDRATNVIRGTKKEQVQQIIKDIKEFKESTKVDKVVVLWTANTERYSNVVVGLNDTMENLFASLDRNEAEISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYSSEIFMGGKNTIVLHNTCEDSLLAAPIILDLVLLAELSTRIEFKAENEGKFHSFHPVATILSYLTKAPLVPPSTPVVNALSKQRAMLENILRACVGLAPENNMILEYK

SEQ ID NO: 249 - protein, 535 aa, Glycine max
MALNYPFLTYFILLLVTITRLIFTVGKTEQWKAPILPELDIDNISHKLHDDPETIQMASRDYGHLTHEFPLAVFRPSSIDDIVTLIKSSYNSFAPFDIAARGQGHSTHGQAMARDGIVVDMASLRKQRNGVAISVSKDPLMGHYADVGGEQLWIDVLHATLEYGLAPVSWTDYLYLTVGGTLSNAGISGQSFRYGPQISNVHEMDVITGKGEFVTCSSQKNLELFHAVLGGLGQFGVIARARIALEPAPKRVKWVRLLYSDFSAFTKDQERLISINGRKQKNALDFLEGMLLMNQGPINNWRSSFFPLSDHPRIASLITEHSILYCLEVAKYYDEQTELNVDKEIEVLLQGLAYIPGFNYEKNVSYVEFLNRVRSGELKLQSQGLWEVPHPWLNLFIPKSQILDFNSGVFKDIVLKRNISSGPVLVYPMNRNKWDDRMSASIPDEDVFYTVGFLHSSGFDTWKAYDAQNREILEFCRDAGIMVKQYLPNHSTQEDWTNHFGAKWMKFLERKHQFDPRMILSPGQKIFHKKLQPVF

SEQ ID NO: 250 - protein, 419 aa, Glycine max
MGIPWDDVVVIQQGKDHNEPCIVTVNCPDKAGLGCDLCRIILEFGLRITRADISTDGRWCYIVYWVLAHPASLNVDWESLKTRLLSACPSCLLSYHFNQHSTSPSPPPIYLLKVWCVDQKGLLHDINEILCNLELIIQRVKAMPTPDGRVLDMFFITDGMELLHTKKRQDYVCEYLMDALGERCISSELQLAGPEYGHLQGFSSLPPAFAEELFSSELLDKLSLHPLSQDMTTLKTPTVTVDNSLSPVHTLLQIQCVDQKGLCYDIMRISKDSDIKVAFGRFSSSVKGFRNIDLFVQHNDGKKIIDPESQKTLCSCLKEEMLHPLRVTIVNRGPDTELLVANPVELSGKGRPRVFYDVTLTLKALGVGIFSAEVVRHSTQERQWEVYRFLLEESRDFPLTRSQARTQIVDKVRRTLMGW

SEQ ID NO: 251 - protein, 113 aa, Glycine max
MSPKYMSLFLLVILGMAFLATTSLADRRFLSVEDGHDHHHHHPPKKHWPPTTQNEPSNVENKENTEVEDGHDHHHHYPPKKHWPPTTQNEPSKVENKDGHYKPPHKKHPPSGN

SEQ ID NO: 252 - protein, 355 aa, Glycine max
MATQSEENATKFLQAYTQIDDHSLRFIHSMSLKCAIDLSIPDIIHKYGQPMPLSQLIASLPIHPSKTCYIHRLMRLFTHSGFFSRHDLVENEQEVITYELTDASRLLLKDHPFSLRPLLLVTLDPSVIKSWCQFSTWLTSEDRTPFQTENGVTYFDYAKRDPKFGHFYNDAMAKDTRFASSVVIENYKEVFEGLKSIVDVGGGIGTMAKAIAKAFPQVKCTVFDLPHVVDGLQGTENIEYVGGDMFEVIPAADCIMLKWVLHCWNDEECMKILKKCKEAIPSDGKVIIMELVMEHNKEDNKLIEMQLCCDMLMMSLFAGKDRTEKEWAHLIASAGFSNYKITHIFDLYHIIVVYP

SEQ ID NO: 253 - protein, 355 aa, Glycine max
MATQSEENATKFLQAYTQIDDHSLGFIHSMSLKCAIDLSIPDIIHKYGQPMPLSQLIASLPIHPSKTCYIHRLMRLLTHSGFFSRHDLVENEQEVITYELTDASRLLLKDHPFSLRPLLLVTLDPSVIKSWCQFSTWLTSEDRTPFQTENGVTYFDYAKRDPKFGHFYNDAMAKDTRFASSVVIENYKEVFEGLKSIVDVGGGIGTMAKAIAKAFPQVKCTVFDLPHVVDGLQGTENIEYVGGDMFEVIPAADCIMLKWVLHCWNDEECMKILKKCKEAIPSDGKVIIMELVMEHNKEDNKLIEMQLCCDMLMMSLFAGKDRTEKEWAHLIASAGFSNYKITHIFDLYHIIVVYP

SEQ ID NO: 254 - protein, 560 aa, Glycine max
MDSWVRMLFLIACIVPALVECKVRHYKFNVVLKNTTRLCSSKPIVTVNGKFPGPTLYAREDDTVLVKVNNLVNHNVTIHWHGVRQLRTGWADGPAYITQCPILSGQSYLYNFTLTGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHPFTVVEVDASYVKPFKTDTLSIAPGQTTNALLTADQNSGKYTIVASTFMDSPVVAVDNLTATATLHYTGTLATTPTLLTTPPPRNATQVANNFTNSLKSLNSKKYPAKVPQKVDHSLLLTVGLGINPCPSCTAGNGSRVVAAVNNVTFVMPTTALLQAHYFNIKGVFTTDFPGNPSHVYNYTATPPAAAWQTTNGTKAYRLAFNSTVQVVLQDTGVIAPESHPVHLHGFNFFVVGSDVGNYDPKTDQNNFNLADPVERNTIGVPTGGWVAFRFRADNPGVWFLHCHFEVHTTWGLKMAFLVDNGKGPNESLLPPPKDLPKC

SEQ ID NO: 255 - protein, 560 aa, Glycine max
MDSWVRMLFLIACIVPALVECKVRHYKFNVVLKNTTRLCSSKPIVTVNGKFPGPTLYAREDDTVLVKVNNLVNHNVTIHWHGVRQLRTGWADGPAYITQCPILSGQSYLYNFTLTGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHPFTVVEVDASYVKPFKTDTLSIAPGQTTNALLTADQNSGKYTIVASTFMDSPVVAVDNLTATATLHYTGTLATTPTLLTTPPPRNATQVANNFTNSLKSLNSKKYPAKVPQKVDHSLLLTVGLGINPCPSCTAGNGSRVVAAVNNVTFVMPTTALLQAHYFNIKGVFTTDFPGNPSHVYNYTATPPAAAWQTTNGTKAYRLAFNSTVQVVLQDTGVIAPESHPVHLHGFNFFVVGSGVGNYDPKTDQNNFNLADPVERNTIGVPTGGWVAFRFRADNPGVWFLHCHFEVHTTWGLKMAFLVDNGKGPNESLLPPPKDLPKC

SEQ ID NO: 256 - protein, 274 aa, Glycine max
MDTSYRTGGVKYECLLFDMDDTLYPLSLGLNLFCRKNIQEYMLELLHIEESEVPKMCLDLYREYGTTMAGLKVLGYEFDNDEFHAYVHGRLPYEKLKPDPVLRNLLLSMPQRKIIFTNADHAHAVKVLNRLGLEDCFEGIICFETLNPPKQINCMDVPNDNHVLTDLTENGCFNSHPQILCKPSVEAFEAAIRIANVDPKKTIFFDDSVRNVESAKITGLNTVLVGHSDLVPGADHALNSIHNIKEALPEIWEIEDGNQQQKIQPPTVETMVLA

SEQ ID NO: 257 - protein, 91 aa, Glycine max
MAFVGASKMMSSFGALLAILLLLMSSIMLATAAKPLGRKLLQQGYGGPVPDYGHRDPVPVRPTGRYRRPDPFPAYGHRDPVPVRPIHYGPP

SEQ ID NO: 258 - protein, 539 aa, Glycine max
MEASPSTLDWRGRPSNPAKHGGMIPAAFVLGLQAFEIMAIAAVGNNLITYVANDMHFPLSKAANLVTNFVGTIFLLSLLGGYLSDSYLGSFWTMLLFGFVELSGFILLSVQAHVPQLKPPPCNVNDGEQCVEAKGMKAMIFFVALYLVALGSGCVKPNMLAYGGDQFEQNDPKQLKKLSTYFNAAYFAFSVGQLVSLTILVWVQTHSGMDVGFGVSAAVMAMGLISLICGTLYYRNKPPQGSILTPVAQVLVAAFSKRNLPSSPSSMIRVEQVEQVKILLSVIPIFSCTIVFNTILAQLQTFSVQQGRAMDTHLTKSFNIPPASLQSIPYILLIFLVPLYDTFFVPFARKFTGHESGISPLRRIGFGLFLATFSMVAAALLEKKRRDAAVNHHKVLSIFWITPQYLIFGLSEMFTAIGLLEFFYKQSLKGMQAFFTAITYCSYSFGFYLSTLLVSLVNKITSTSSSSAAGWLHNNDLNQDRLDLFYWLLAVLSFLNFLNYLFWSRRYSHAPSALPQPNNAKEINPYSQLHDHHHNNIIP

SEQ ID NO: 259 - protein, 332 aa, Glycine max
MRGSCWWNRRTEQRFRLLAISTVKSLKIKLLLCCCVAFTLLAFSTSASSFVLWINNQTPPPPPRFPDSRKGYSIVMNTWKRYDLLKQSIKHYSSCPRLESVHIVWSEPDPPSDNLLKFLHHVVKSKSKDGRYVKLRFDINKEDSLNNRFKEIKDLETDAVFSIDDDVIFPCSTVEFAFDVWQSAPDTMVGFVPRVHWVDSMEGNDNKFIYGGWWSVWWTGTYSMVLSKAAFFHKKYFNIYTNEMPSSIREYVTKNRNCEDIAMSFLVANATGAPPIWVKGKIFEIGSTGISSLGGHSERRTECVNRFAAVYGRMPLVSTSVKAVDSRNIWFW

SEQ ID NO: 260 - protein, 334 aa, Glycine max
MRGSCWCWNRRTEQRFRLLAISTVKSLKIKLLLFCCVAFTLLAFSTSASSFVLWINNQTPPPPPPRFPDSGKGYSIVMNTWKRYDLLKQSIKHYSSCPRLESVHIVWSEPDPPSDILLKFLHHVVKSKSKDGRYVKLRFDINKEDSLNNRFKEIKDLETDAVFSIDDDVIFPCSTVEFAFDVWQSAPDTMVGFVPRVHWVDSLEGNDSKFIYGGWWSVWWTGTYSMVLSKAAFFHKKYFNIYTNEMPSSIREYVTKNRNCEDIAMSFLVANATGAPPIWVKGKILEIGSTGISSLGGHSERRTECVNRFVAAYGRMPLVSTSVKAVDSRNIWFW

SEQ ID NO: 261 - DNA, 1340 bp, Soybean
agtagttattatttccaattaaaatctcttcatttttctctctttgttacattttcattatggtgaccaagatatgatctgttatcaatatatattcaatgacatacacagtcccgagtgctaaacctgagttgtgtctcaagttgctcttcttctttttttcttttctttcaccctcaaaatttctcactctctttatcttcaccttttcagtttaaagcttcagatcacaacagatccaccattcacctcaccactttctcttcacaaggcaaatctaacaagaaaaagtagtctctgaagccgatccagtgtcttgtgaatttggaattggtggtgaatttagatctaaaaagccatagcaatgtcttttatcggtacccagcaaaagtgcaaggcttgtgagaaaacggtttatccagttgatcagctttctgctgatggcactgcttatcacaaagcttgcttcagatgttctcactgcaaaggaacattaaagctgagcaactattcctcaatggaaggtgttctttattgtaagcctcactttgagcagctcttcaaggagagtgggtccttcagcaagaacttccagtcacctgcaaagctagcagataagacaacacatgagctgacaaggtctcctagtaaagctgcgagcatgttttctggcacccaagaaaagtgtgccacatgtggcaaaactgcttatccattggagaaggtaacagtggaagggcaggcctatcacaaatcatgtttcaagtgttcacatggtggatgtcccataacgccgtcgaattacgcagcccttgagggcattttgtattgcaagcaccacttctcccagctttttaaggagaaagggagctataatcatcttactaagtctgcctcagtcaaacgtgcagcagcagcagcagcaacagcaactgcaacgaccgtggcctctgttccagaatcttgaatgttggttccttcaattgcccttcctttttcaaatacattttggtctgtcaagcaagtgcttgtatgtgtggccttttttggttttgattgttctctcgtgactttgatcattttctgatatttttacttacaacatgcgtggcgtgcaaatcttgtgtggtttattttatacaatggacattcagtaatgacttgactaatgagagcgtgatttgcaagatactatatcattccaaggtttggttatcttgctgcctttagtttcttggatgttttgattcagggcatctggaaagtgatttcttattaaatatattgatcataaattgagaaaatatattttaataaaatataagtatttgttatctttt

SEQ ID NO: 262 - DNA, 1337 bp, Bean
taatatttgcaataaaaatgtattaattttctgtgctgaatggattttcattatgatgagcaaggtatgatctgttatcaatcaatatatattgaatgacattcatattcccgagttgtggtttcaacttcctcttctttttcttctcattcactttcgccctcaaaatttctcattctatctttatcttcaacttttcagttcaaagcttcagatcacaaccgatccaccattcaccactttctcttcgcaagctcaagttattgtcataggcaaatctaacacgaaaagtagtcactgaagccgatccagtgccttgtgaatttggaattggtggtgaatttagatctaaacgccacagcaatgtcttttatcggaacccagcaaaagtgcaaggcttgtgagaaaacggtttatcccgttgatcagctttctgctgatggcactgcttatcacaaagcttgcttcaggtgctcccactgcaaaggaacattaaagctgagcaactattcctcaatggaaggtgttctttattgtaaacctcactatgagcagctcttcaaggagactggcaccttcagcaagaacttccagtcacctgcaaagttagctgataagactactcctgagctgacaaggtcacctagtaaagctgcgagcatgttttctggcacacaagaaaagtgtgctacatgtgggaaaactgcttatccattggagaaggtaacagtggaagggcaggcctatcacaaatcatgtttcaagtgttcacatggtggttgtcccataaccccatctaattatgcagcccttgagggcattctgtattgcaagcaccatttctcccagctttttaaggagaaagggagctataatcatctcacaaagtctgcatcaatcaaacgggcggcggcggcagcagcagcagccactgttccagaatcttgaatgttggttccttcttctattgccttttctttaacaaatacattttggtctatcaagcaagtgtttgtatgtgtgcctttttttttttcttttgatcgttctgtggcgactccatcatttctgatttttttttacttacacatgcgtggcgtgccaaatcttgtgtgctttatttatacaatggacattccgtaatgaccaatgagtgcgtgatttgcgagatatttcactctaatttgatgatattagccttcattgcatttatatttatattcttattctgccttaggtctcataacacaaaagagttgatacaatacaattttccatttaaattcttaacttgagattatttgagaaaagatacactgaaaagatttaagattagt

SEQ ID NO: 263 - DNA, 1097 bp, Cowpea
ggctaacctgagttgtgtctcaacttcgtcttcttgttctcttattcactgtcgccctcagaatttctcactctatctttatcttcagcttttcagttcaaagtttcagatcacaaccgatccaccattcgccactttatctcgcaagctcaggttattgtcataggcaaatctaacactaaaagtagtcactgaagccgatccagtgccttgcgaatttggaattggtggtgaatttagatctaaaagccacaacaatgtcttttatcggaacccagcaaaagtgcaaggcttgtgagaaaacggtttatcccgttgatcagctttctgcagatggcactgcttatcacaaagcttgcttcaggtgctcccactgcaaaggaacattaaagctgagcaactattcctcaatggaaggtgttctttactgtaaacctcactatgagcagctcttcaaggagactggcaccttcagcaagaacttccagtcacctgcaaagttagctgataagactactcctgagctgacaaggtcacctagtaaagctgcgagcatgttttctggcacacaagaaaagtgtgctacatgtgggaaaaccgcttatccattggagaaggtaacagtggaagggcaggcctatcacaaatcatgtttcaagtgttcacatggtggttgtcccataaccccatcgaattatgcagcccttgagggcattctgtattgcaagcaccatttctcccagctcttcaaagagaaagggagctataatcatctgacaaagtctgcatcaatcaaacgggcggcggcagcagcagcagccactgttccagaatcttgagtgttggttccttcttctattgccttttctttaacaatacattttggtctatcaagcaagtgtttgtatgtgtggcttttttttcttttttcatcgttctctcgcgacttcatcatttttgatattttttacctacacatgcgtggcgtgcaaatcttgtgtggtttatttatataatggacattacgtaatgactaatgagtgcgtgatttgcgagattatcattccaatttgatgatattattscctccattacat

SEQ ID NO: 264 - DNA, 1155 bp, Pigeonpea
ggattttcattaaggtgaccaagacatgatctgttctccatatatattcaatgacattcatagtctcaagagtcccaacctgagtcattgtgtctcaacttgctcaaacttattctctctcaccctcacaatttctcattctctctctatcttcaccttttcagttcaaagctttagatcacgacacaacacaaccgatccaccattcaccactttctcttcacaagtctctgaagccgatccagtgccttgtgaatttggaattgctggtgaatttagatctaaaagccacaacaatgtcttttatcggtacccagcaaaagtgcaaggcttgtgagaaaacggtctaccccgttgatcagctttctgctgatggcactgcttatcacaaagcttgtttcagatgctctcactgcaaaggaacattgaagctaagcaactattcctcaatggagggtgttctttactgcaagccacactatgagcagctcttcaaggagactggcactttcagcaagaatttccagtcacctgcaaagttagcagataagacaacccctgagctgacaaggtcccctagtaaagctgcaagcatgttttctggtacacaagataagtgtgctacatgtggcaaaactgcttatccattggagaaggtaacagtggaagggcaggcctatcacaaatcatgtttcaagtgttcacatggtggttgtcccataaccccatcaaattatgcagcccttgagggaattttgtattgcaagcaccatttctcccagctttttaaggagaaagggagctataaccatcttatcaagtctgcatcaatcaaacgggcagcagcagcatctgttccagaatcttgaatgttggggttccttctgttgttgccttttctttttctaatacattttgttctatcaagcaagtgtttgtatgtgtggccctttttgttttgattgttctctcttgaatttgatcacttctgattctgatttttacttacacatgcgtggcgtgcaaatcttgtgttgtgctttatttatacagtggacattcagtaatgactaatgagagcgtgatttgcaagatatatctatccaagtttatgacattgcattttctgccgaatgctatcttataagtatttat

SEQ ID NO: 265 - DNA, 1097 bp, Lotus
aatcacattatggagaccatgatatagccatttcttatcaatattttgatatccaattataacgtttggtgttgaacttgctctgttctgtgggtatatcttttatctttacccttcaaaatcttcttcttctttagctataaagcttcaatctttagatcacacccaccttcccgatccaccatttcccaattcattctctcttcgcaagatctagaagccacagcgatgtcttttcttggtacccagcaaaagtgcaaggcttgtgagaaaacagtgtatcctgttgatcagctttctgctgatggtacttcttaccataaagcttgcttcaggtgctctcactgcaaaggaacattgaagctgagcaactattcctcaatggaaggtgttctttactgcaagcctcattatgagcagcttttcaaggagactggcacattcaagaagaacttccagtcgcctgcaaagctagctgacaagaatactcctgagctgacaaggtccccaagtaaagctgcgggcatgttttctgggacacaagaaaagtgcgctacatgtggcaagactgcttatccattggaaaaggtaacagtggaaagtcaggcctatcacaaatcatgtttcaagtgttcacacggtggttgtcccataactccatcgaattatgcagcccttgagggcattttgtattgcaagcatcatttctctcagctttttaaggagaaagggagctataatcatcttattaagtctgcatcaatcaaaagggcagcagcctcagttccagaatcttgattgttggtgtcttgtattgctttcaatttttttaaagaagatatttggtctatcaatcaagtgtttgtatgtgtggccttttttttcaattgttctatagtgacttgatccttttctgatatttccttctatgtctggcgtggatttcttgtgtgatttatttatccaatgcacattcagtaatgaccaatgagagcgtgatttgcaagatctaactttccaagttgatgacagccttttgttgtattctctactggatgctgttgtattcttagagagtaaggaaatcaatttatcct

SEQ ID NO: 266 - DNA, 891 bp, Chickpea
gagtctcaaccgaagaagacttcaattttgtgtgaagttgcttcattttcccctttatcttcaccgatccaccatttctcactttctattcacaagatctaaaaagatagagcgatgtctttcattggtactcaacaaaagtgtaaggcttgtgagaaaactgtttatcccgttgatcagctttctgctgatggcacttcttaccataaagcttgtttcagatgctctcactgcaaaggaactttaaagctgagcagctattcctcaatggaaggtgttctttactgtaagcctcattatgagcagctcttcaaggagactggcaccttcaagaagaacttcacgtcacctgcaaagttagctgacaagacaactcctgagctgacaaggtcccctagtaaagctgcaagcatgttttctgggacacaagacaagtgtgccacatgtggcaaaactgcttatccgttggagaaggtaacggtggaaagccaggcctatcacaaatcatgtttcaagtgttcacatggtggttgtcctataactccatcaaattatgcagcccttgagggaattttgtattgcaagcaccatttctctcagctttttaaggagaaaggtagttataatcatcttatcaagtctgcatcaatcaagcgtgcagcaacatccgttccagaatcttgaatgtttggtgccttctattgcctttgttttgaaggaagaggatgttttggtctgtcaagaatgtgtttgtttgtatgtgtgttctttttcccttcataattgttccatcgatacttgatcctttttctgatctttacttatacatgcgtggtgtgcaaatcttgtgtgatttatttatccaatgcacattcagtaatgacaactgag

SEQ ID NO: 267 - DNA, 1073 bp, Peanut
gagctctgagctgtgtgtgaagtggctattcttatttcttcttctttttgggtttcttcttcagccctcagaatcgctcatagtctcaatcttaagctttaaaaagctttagatcgtaacaaacccttttacacacagcatcactgatccaccatttctcactttccctttcacaagctgaatttgtttgtgacaggcaaaatctaacaagagaactagtgtctgaagcggatccattgttggattttgatctagaaaagggtcataacgatgtctttcattggcacccagcaaaagtgcaaggcttgtgagaaaactgtgtaccctgttgatcagttatctgctgatggcactgcataccataaagcttgttttagatgctctcattgcaagggaactttaaagctgagcaactattcatcaatggaaggtgtcctatactgtaagcctcattacgagcagctcttcaaggagacgggctcgttcaccaagaatttccagtcatctgctaagttagctgacaaggcaactcccgagctgacaaggtcccctagtaaagctgctagcatgttttctgggacacaagaaaagtgcgctacatgtggcaaaactgcttatccgttggaaaaggtaacagtggaagggcaggcatatcacaaatcatgtttcaagtgttctcacggcggctgtcccataacgccgtcgaattacgcagccctcgagggcattttgtattgcaagcaccatttctcccagctttttaaggagaaaggcagctataaccatcttgttaagtcagcatcgatcaaacgggcagcgacctctgttccagattcttaagaatcttggtgccatctcttgcagtttcatttttcccttccttttttaatcttttctcttcttttttgatctgtcatgaaagtgtttgtatgcgtggctttttcttttcttttctctttttgcttctatgatggcttggttgtttcttacatttctttttaaaacgtgtggtgtgccaatcttgtgtggttttatttatccaatgcacattgacgaatgagagtgtgattttg

SEQ ID NO: 268 - DNA, 1121 bp, Medicago
atgacatgacttattatattccatatatccaaatacattcatcctccttagtcttaaccagagacttaaactttgtgtgaagttgtttcatttctccctctctatcttctcttcaccgatccatcacttccaattcataagctcaagtaattgacttctgaagctgatctaccaccttgtgcattttgaaattcagtggtgaattcagatctaagaagctgcaaagatgtcttttattggtacccaacaaaaatgcaaggcttgtgagaaaacggtttatcccgttgatcagctttctgctgatggaacttcttaccataaagcttgtttcagatgctctcactgcaaaggaactttaaagcttagcagctattcatcaatggaaggtgttctttactgtaagcctcattttgagcagctcttcaaggagcatggcaactttagcaagaacaagaacttccaatcacctgcaaaggtagctgacggtacaacccctgtgctgacaaggacccctagcaaagctgcgggcatgttttctgggacccaagaaaagtgtgctacatgtggcaaaactgcttatccattggagaaggtgacagtagaaagccaggcctatcacaaatcatgtttcaagtgttcacacggtggttgtcctataactccatcaaattatgcagcccttgagggcattttgtattgcaagcaccatttctctcagctttttaaggagaaagggagctacaatcatcttatcaagtctgcatcaatcaaacgtgcagcagcctccgttccagaatcttgaatgttggtgccttctaattgcctttgttctgttttgaaagaagagggtattttgatctttcaagcaagtgtttgttgtatgtgtggttttctttttccttcataattgttccatcattacttgtcatttttctgatgtttacttatacatgtgtggtgtgcaaatcttgtgtgatttatttatccagtgcacattcagtactgacatgagagattgacttgcaaaatgtatctttccaatttcatgatgtaattttcattgcattttctaccgaatactgttattttatataagatagagacaccttggaggcaacaaa

SEQ ID NO: 269 - DNA, 1090 bp, Trigonella
tgaaaatatcctcactttccttattaataacgtattttacataatggtgaccatgacatgacttacattatcgcatccaaagacattcatcctccttagtcttaaccggagacttgaactttgtgcgaacttgcttcattcccctcaatcttcaccgatccaacacttctcaagctcaagtaatcattctctaaagctgatctacaaccttgtgcattttgaaaatcaacgttcaattcagatctaaaaagctacaacgatgtcttttattggtacccaacaaaagtgtaaggcttgtgagaaaactgtttaccccgttgatcagctttctgctgatggaacttcttaccataaagcttgtttcagatgctctcactgcaaaggaactttaaagcttagcaactattcatcaatggaaggtgttctttactgtaagcctcattttgagcagctcttcaaggagcatggcaacttcagcaagaacaagaacttccagtcacctgcaaaggtagctgacagtacaactcctgtgctgacaaggacccctagcaaagctgcgggcatgttttctgggacacaagaaaagtgtgctacatgtggcaaaactgcttatccattggagaaggttacggtggaaagccagtcctatcacaaatcatgtttcaagtgttcacacggtggttgtcctataactccatcaaattatgcagcccttgagggcattttgtattgcaagcaccatttctctcagctttttaaggagaaagggagctataatcatcttatcaagtctgcatcaatcaagcgtgcagcagcctccgttccagaatcttgaatgtcggtgccttctactgcctttgttttgttttgaaagaagagggtgtctcggcctgtcaagaaagtgtttgtatgtgtgtttttttcccccttcataactgttccatcagtacttcatcatttttctgatgtttacttatacatgtgtggtgtgcaaatcttgtgtgatttatttatccaatgcacatttagtaatgacaaatgagagattgacttgcgaaatgtatctttccaatttgatggtgcagttttt

SEQ ID NO: 270 - DNA, 1200 bp, Apple
ggggtctctctatctctctctctctctctataatttcatcatcgtcgtcttctccactacgctgcatccgctccctgcaaaaagcgctcgccatatccatccgcttgccatcacactccttccgtacggaaaaggacccatttgcccttcctcacccatttcgttttcaaaatcttttcttttttattttaccctttttaattatcgagatttttgagcttcactcagtcagccttaaagcttcaaagggtggaaggttgagagggggtgatcttggtaaaaagagaagaatcagatctagaaggagatagaaatatgtctttcattggcacccagcagaaatgcaaggcttgtgaaaagacagtttacccagtggaggagctatctgctgatgggatttcctaccacaagtcttgcttcaaatgcacccactgcaaagggactttgaagctgagcaattattcctcaatggaaggtgttctatactgtaagcctcactttgagcaacttttcaaggagactggcaatttcaacaagaactttcagtcacctgcaaagtcagctgagaagttaactccagagctgactaggtctcctagcaaagctgctagcatgttttctggaacacaagacaaatgtgctacttgtggtaaaaccgcttatccactggagaaggtgactgtggagagccaggcctatcacaagtcgtgtttcaagtgttctcacggcggctgtcctattactccctcaaactacgcggctttggagggcattctatactgcaagcaccatttctcccagcttttcaaggagaaggggagctacaaccatcttattaagtctgcatcaattaagcgcacagcagcggcggcggcggcagcaacagcagcagtagcctccattccagaagcataaattccatatttaaatgttcgatcacatggctttcgtttgtttaagagtgttgtattcctcttcagcctcatgcttttccatggcggagtgagaaaacttggtacttctctattttatttggctcatcaatcttgggcacattgttgtgttttgcttcccgtatgtgattctgggtccggcagttgtaaaaagaccttcagggctttgtttgcagtaagttcatgttgtcaccatttttctcggcatttggcaaatatatgaaaagagtctgtcatcttcgtttca

SEQ ID NO: 271 - DNA, 1206 bp, Prunus
ctctaattggatttgggggggtctcgaatataatttcatcgtcgtcatccaccactacgctgtatccgctcgctgcaaaaagtgctcgccatctccacctttctccagtacgccaggacccatttacttattgttcctctcatttcatctttcaaaatctattcttttttctgtttccatttttcatttattgacattttcaagctcagtcaatcagccttaaagatccaccattttctcactttattcaaaggatagaaggttgagaggaaggccaaaatctgcgtcgaagcctgtggtgatattggataatagagaagaatcagatctaaaagcattaagaagcatgtctttcattggcacccagcaaaaatgcaaggcttgtgaaaagacagtttacccagtagaggaactctctgcggatggtgtgtcctaccacaaggcttgcttcaaatgcacccactgcaaagggactttgaagctgagcaattattcctcaatggaaggtgttctgtactgtaagccccacttcgaacaactcttcaaggagactggcaatttcaacaagaactttcagtcacctgcaaagtcagctgagaagttaactccagagctgactagatcacctagcaaagctgctagcatgttttctggaacacaagaaaaatgcgctacttgtggtaaaaccgcttatccactggagaaggtgacagtggagagccaggcctatcacaagtcgtgtttcaagtgttctcatggcggctgtcctattactccatcaaattatgctgccctggaaggcattttatactgcaagcaccatttctcccagcttttcaaggagaaggggagctacaaccatcttattaagtctgcatcgattaagcgcgcagcagcagcagcagcatccattccagaagcataaatgccatactttatggtttgattacatggctttcttttgtttaagagtgttatatccccctcaacctatgctttccatggtggagtgagaaacttgattcttatctgttgtctctttggctcatcaatcttgggcacattgttgtgttttgcttgatgaatgtggtgcgattccgatagttgtaaaatgaatttcttcaggactttatttgcagtaagtttatgttgtcaccattttgttcgactttttacgaagatatgaggagtctatattttcgtttc

SEQ ID NO: 272 - DNA, 1202 bp, Apple
ctctcacgctctaatctcgacaatttcgtcgtcgtcgtcttcctgcactacgctgcatccgctccctgcaaaaagccttcgccattcaccgtccggcatttcattccttctgtacggaaaaggacccatttgccctcctcccttttctcgctctttccatttttcaaaatcttttcttttttattctaccctttttatttgtcgagattttttagcttcactcagtcagccttaaagcttcaaagggcgggaggttgagtggtggtgatcttggttgagagagaagagtcagatctagaaggagaaagaattatgtctttcattggcacccagcagaaatgcaaggcttgtgaaaagacagtttacccagtggaggagctttctgctgatgggatttcctaccacaagtcttgcttcaaatgcacccactgcaaagggactttgaagctgagcaattattcctcaatggaaggtgtcctgtactgtaagcctcactttgagcaactgttcaaggagactggcaatttcaacaagaactttcagtcgccagctgcaaagtcagctgagaagttaactccagagctgactaggtcacctagcaaagctgctagcatgttttctggaacacaagacaaatgtgctacttgtggtaaaacagcttacccactggagaaggtgacagtggagagccaggcttaccacaagtcgtgtttcaagtgttctcacggcggctgtcctattactccctcaaactacgctgccctggagggcattttatactgcaagcaccatttctcccagcttttcaaggagaaggggagctacaaccatcttattaagtctgcatcaatcaagcgcacagcagctgcagcagcagcggcagcagcaacagtagcctccattccagaagcataaattccgtatttaaatgttcgattacatggctttcgtttgtttaagagtgttgcatccctctttaacctcacgcttttccatggcggagtgagaaaacttggttcttctcttttgtattcggctcatcaatcttgggcacattgttgtgttttgcttcatgtatgtgattctgggtccggcagttagtaaaatgaccttcttcgggactttgtgtgcagtaaagttcatgttgtcaccatttttatcggcattttgcaaatatatgaagattctatcatcttcgtctt

SEQ ID NO: 273 - DNA, 1077 bp, Soybean
agtggaggcaggaaagatatctaatatctatatcctatctcccaaatagtagtttatggttaatactatattacttgacactggtcattactcatcatcatttgatttgttgttatcaatcaatttaatatattcatatccttccacctgagttcttagtcctgaatgtccttgtctgtctcagtgtctctcttcacaacctcaccgatctgccatttctcactcataacaactttgtacaatttgactcgatatgttgaagtttctctgcagctaaattgaccaatcgtttggtgcacttagatctaaaagctagaaagatgtcttttattggcactcaacaaaagtgcgaggcttgtgacaaaacagtgtaccccgttgatcagctttctgctgatggcactgcttatcacaaagcatgcttcaagtgctctcattgcaaaggaaccttgaagctcagcaactattcctccatggaaggtgttctatactgtaagcctcattatgagcaactcttcaaggagacaggatctttcaagaagaacttccagtcacctgctaagcaagctgtcaaaacaactcctgagctgacaaggtctcctagtaaagctgctagcatgttttctgggacccaagaaaagtgtgctacatgtggcaaaactgcttatcctttggagaaggtaacagtggaaggtcaggcctatcacaaatcttgtttcaaatgttcacatggcagctgtcccataactccatccaactatgcagccctggagggcgttttgtattgcaagcaccatttttcccagctttttaaggagaaagggagctataatcatcttattaaatctgcatcaatcaaacgggaagcaaactctgttccacaagcttgagtcatggtgttgtcttttgttgttattatcatctttggaataagtgtttgtgtttttttcattttgattctacttaccatgacaagtttccttcttgttcactttatatgtgggtgtcgctagtgtgcaatttacagtgtgtgatgtatttgaccaatgcacattcagtaataatagtgtgatttgc

SEQ ID NO: 274 - DNA, 912 bp, Walnuts
gctgcataaaacgtctctctgaccctccgctttcaatccccatttccgaacttttagcttttagatcgagcccaattccgtgaagctctcagatccacaattgctctatttttcgagttcttggtagataagtttgttgctggaaagaaaatccacttcccgtattttggaaccgatctatttccttggggttggcggtaatttaagcatttagagaagagctagatccgaggcggagatatgtctttcactggcacccaacagaaatgcaaggtctgtgagaagacggtttatcctgtagaacagctatctgccgatggggttgtctaccacaagtcttgcttcaagtgctcccactgcaaagggacgctaaagctcagcaactattcttcaatggaaggggttttatactgtaagcctcactttgaacagctattcaaggagacgggtaatttcaacaagaattttcagtcacctgcaaagtcagctgagaagttaactcccgagctgactaggtcaccaagcaaagctgccagcatgttttctgggacacaagaaaagtgtgctacctgtggtaaaactgcttatccactggagaaggtgacggtggagagccaggcctatcataagtcatgtttcaagtgctcgcatggcggttgtcctataaccccatctaattatgcagccctggaggggattttatattgcaaacaccatttctcccagcttttcaaggagaaagggagctacaaccatcttatcaagtctgcatcaattaaacgtgcagcagcagcagcctccattccagaggcttaaagtccccaatccttaaactatgggtttgattacattccttttcttttttattattgtgtgtttcttctgattcctgacctcaaaggtgggggaact

SEQ ID NO: 275 - DNA, 1179 bp, Strawberry
ttaaatcactcataaaatctctctcattggatgtttttgaggggggcctagtctttctagttgttctataatttcaatcatcgtcttcctccactcctctccatccgctcgctgcaaaaagcgctccggatctcattccctctcattcccgtcacccattttcctttattctcccatttcaattttcaataccaactttttctccctaccccatttgtttttgattagtcagccttgaaagatccaccattttttttgctcacagagctccagaggttgagaggaggggagttctttgggcaatagaaaagagccagatctaagaagcacaagggaattatgtctttcattggcacccagcagaaatgcaaggcttgtcaaaagacggtttacccagttgaggagctttctgcagatgggatttcctaccacaagtcttgcttcaagtgcactcactgcaaagggactttgaagttgagcaattattcctcaatggaaggtgttctgtactgtaaacctcactttgagcaactcttcaaggagaccggaaacttcaacaagaacttccagtcacctgcaaagtcagctgagaagctaacaccagaaatgactaggtcacccagcaaagctgctggtatgttttctggcacgcaagaaaaatgtgctacttgtggtaaaaccgcctatccactggagaaggtgacagtggagagccaggcatatcacaagtcgtgttttaagtgttcccatggtggctgtcctattactccatcaaattatgcagccctggagggaattttatactgcaagcaccatttctcccagcttttcaaggagaaggggagctacaaccatcttattaagtctgcatctattaagcgcgcagcagctgcaacagcgacagcagctgcagcagcagttgccagcattccagaagcctaaatgccaagtttatagtttctttacatctgctttcttttaagagtgtgttctcttagacggtacttgtcatggctgagtgagtaaactttgtctgtcttctctattttctttggctcaatgaacttgggcacattcttgtgtttgcttgatgtatgcgatgcagactgacaattgtaaaacaacctcttttttctctctttcaatttacgcaagttcatgttacttttgccaaagaga

SEQ ID NO: 276 - DNA, 1071 bp, Chestnut
tttctttcttgggttttcttagatcgagaagtgtcaaactcacagatccacttttattctctttgttcagttcttggagtagataagattgctgtttggaaaaggaaaatctgaacaggaagtgattttgaagcggatccatcgccttggatttggcggtatatttagtacttagagagaagagtcagatccaaggcaatggctatgtctttcactggcacccaacagaaatgcaaggtctgtgagaagacagtttatccagtagagcagctatctgctgatggggttgtttaccacaagtcttgcttcaagtgctcccactgcaaagggaccctaaagctcagtaactattcttcaatggaaggtgttctgtactgtaagcctcactttgagcagctcttcaaggagacgggtagtttcaacaagaattttcagtcacctgcaaagtcagctgagaagttatctccagagctgactaggtcacctagcaaggctgcaagcatgttttctgggacacaagaaaaatgtgctacttgtggtaaaactgcttacccacttgagaaggtgacagtggagagccaggcttaccacaagtcatgtttcaagtgctctcatggtggttgtcctataacaccatctaattatgcagctctagagggcattttgtattgcaaacaccatttctcccagcttttcaaggagaaagggagctacaaccatcttatcaagtctgcatcaatgaagcgtgcagcagcctctacgccagaggcttaaactccctatcatttattatggtttgattacatggttttctctttgtttatgggtgtgtttcttctgatacctaattttcttggtggagaattggcaaaacttgtttctctctttgcttttagctcatcatcattgttgggcgtactgttgtgtttgcttgaacatgggatgcaaatccagcttttgtaaaacgacttgcaggacattattttgcagaaacttcatgagctttatgtaccttttgttttggcttgttacaaagatatggagtgagaaaaagttcatttcaaaaaaaaa

SEQ ID NO: 277 - DNA, 1360 bp, Oak
atggggattgagaatcgttgaaccagacaaagtggagacaaaagtgtttccagccaagataatttttgcccactttttattattattcccctatattctctctctatattcttctctgtatctttaggggtgtattagtattttactacttttatctacatgtttcacttcgctgcatccgttagctgcatataacctctctgacccttttcgtattccacttccttcctccatttctcaactttctttcttgggttttcttagatcgagaagtgtcaaactcacagatccacttttattctctttgttcagttcttggagtagataagattgctgtttggaaaaggaaaatctgagcaggaagtgattttgaaacggatccatcgccttggatttggctgtatatttagtacttagagagaagagtcagatccaaggcaatggctatgtctttcactggcacccaacaaaaatgcaaggtctgtgagaagacagtttatccagtagagcagctatctgctgatggggttgtttaccacaagtcttgcttcaagtgctcccactgcaaagggaccctaaagctcagtaactattcttcaatggaaggtgttctgtactgtaagcctcactttgagcagctcttcaaggagacgggcagtttcaacaagaattttcagtcacctgcaaagtcagctgagaagttatctccagagctgactaggtcacctagcaaggctgcgagcatgttttctgggacacaagaaaaatgtgctacttgtggcaaaactgcttacccacttgagaaggtgacagtggagagccaggcctaccacaagtcatgtttcaagtgctctcatggtggttgtcctataaccccatctaattatgcagctctagagggcattttgtattgcaaacaccatttctcccagcttttcaaggagaaagggagctacaaccatcttatcaagtctgcatcaatgaagcgtgcagcagcctctacgccagaggcttaaactccctatcatttattatggtttgattacatggttttctctttgtttatgggtgtgtttcttctgatacctaattttcttggtggagaattggcaaaacttggttctctctttgcttttagctcatcatcagtgttgggcgtactgttgtgtttgcttgaacatgggatgcaaatccagcttttgtaaaacgacttgcaggacatcatttttcagaaacttcatgagctttatgtaccttttgttttggcttgttacaaagatatggagtgagaaaaaggttcatttctactgtctgttctttctacctgtcccctttaccttcaaaacatttgtcagtctta

SEQ ID NO: 278 - DNA, 961 bp, Centaurea
tcggtccggattcccgggatcttccacaagctttgtttttggctgattgatatataaacaaatatatatcaagcattcccccatttctttacaacattccctactatttgacctctgtattcagacaactttgacttccatcaacaaatccaactcaaatttgtctgaattcatccaggtgttgattgagattgaatctggattaaaaaagggtggtgtaaagatttgaagatcagatccagagggggaaagggtaattatgtcttttactggaacacagcagaaatgcaaggcttgtgggaagactgtttacccagtggagcttttgtctgctgatggtattgattaccataaatcttgcttcaagtgtagccattgcaaaggtacccttaagctgagtaattactcatcgatggaaggcgtgctctactgcaagcctcacttcgagcagctcttcaaggagagtggaaatttcaacaaaaacttccaatcacctgcaaaggcagcagataagtcatctccaatgctgacaaagtcacctagcaaagctgctggcatgttctccgggacccaagagaaatgcgcaacttgtggcaaaacggcttatcctctggagaaggtaacagtggagaaccaagcataccacaaatcatgtttcaagtgctcccatggaggctgctctttatctccatcaaactatgcagcattggagggaattttgtactgcaagcatcatttctcacagctattcaaggagaagggcagctacaatcatctcatcaagtctgcatccatcaagcgctctgcagcagcggcaacagcggcggcggcatcaccaaccaccgcctctattcctgaagtttgaaacactctgcatgttatcatcatcatcatcatmtgaacaaagtttttggtttgtttttgcttgtgtttgtttttatcggttatggttgatgattat

SEQ ID NO: 279 - DNA, 949 bp, Cirsium
atctctcttccacaagctttggttttggccgattgatatataacaaaaaccccgtttctttacgctgcgtctaaacattccctattatttgacttctgtattcagacatctttgacttccatcaacaaatccaactcaaatttggctgaattcatccaggttttgattgagattgaatctggattaaaaagggtggtgtaaagatttgaagatcagatccagagggggaagggtaattatgtcttttactggaacacagcagaaatgcaaggcttgtgggaagactgtttacccagtggagcttttgtctgctgatggtattgattaccataaatcttgcttcaagtgtagccattgcaaaggtacccttaagctgagtaattactcgtcaatggagggtgtgctctactgcaagcctcacttcgagcagctcttcaaggagagtggaaatttcaacaaaaacttccaatcacctgcaaaggcagcagataagtcatccccaatgctgacaaagtcacctagcaaagctgctggcatgttctccgggacccaagagaagtgcgcaacttgtggcaaaacggcttatcctctggagaaggtaacagtggagaaccaagcataccacaaatcatgtttcaagtgctcccatggaggctgctctttatctccatcaaactatgcagcattggagggaattttgtactgcaagcatcatttctcacagctattcaaggagaagggcagctacaatcatctcatcaagtctgcatccatcaagcgctctgcagcagcggcaacagcggcggcggcatcaccaaccaccgcctctattcctgaagtttgaattgcatgttatcatcatcttatgaacaaagtttttggtttgtttttgcttgtgtttgtttttatcggttatggttgatgattattccattccagggaactgact

SEQ ID NO: 280 - DNA, 880 bp, Cirsium
tatttgacctctgtattcagacaactttgacttccatcaacaaatccaactcaaatttggctgaattcatccaggtgttgattgagattgaatctggattggaaaagggtggtgtaaagatttgaagatcagatccagagggggaaaagggtaattatgtcttttactggaacacagcagaaatgcaaggcttgtgggaagactgtttacccagtggagcttttgtctgctgatggtattgattaccataaatcttgcttcaagtgtagccattgcaaaggtacccttaagctgagtaattactcgtcaatggagggtgtgctctactgcaagcctcacttcgagcagctcttcaaggagagtggaaatttcaacaagaacttccaatcacctgcaaaggcagcagataagtcatctccaatgctgacaaagtcacctagcaaagctgctggcatgttctcggggacccaagagaaatgtgcgacttgtggcaaaacagcttatcctctagagaaggtaacagtggagaaccaagcataccataaatcatgtttcaagtgctcccatggaggctgctctttatctccatcaaactatgcagcattggagggaattctgtactgcaagcatcatttctcacagctattcaaggagaagggcagctacaatcatctcatcaagtctgcatccatcaagcgctctgcagcagcggcaacagcggcggcggcatcaccaaccaccgcctctattcctgaagtttgaaacacttgcatgttatcatcatcttatgaacaaagtttttggtttgtttttgcttgtgtttgtttttatcggttatggttgatgattattcccattccagggaactgactaaaacttt

SEQ ID NO: 281 - DNA, 1031 bp, Ambrosia
ccactaagctgcaaaaagcacatctattccactacattgcttgatatatatatctataaatataaaaatatctcacacattttctttgcgctgcattcaacattccccaagattttgacctctgtgttcttcttcttcatctctgcaactaaatcagaacattcttaactttaatcaacaaattcaactcaacaagactgttcatttattaaggaggtgaagggaaaagattaaggtcagatccaaaggggaagagggcaattatgtcttttattggaacacagcaaaaatgcaaggcttgtggaaagactgtttaccctgtggagcttttgtctgctgatggtattgattatcataaatcttgcttcaagtgtagccattgcaaaggcacacttaagctgagcaattactcgtcaatggaaggagtgctctactgcaagcctcactttgagcaacttttcaaggagagcggcaacttcaacaagaacttcacatcacctgcaaaggctgctgataagttatctccaatgctgacaaagtcacctagcaaagctgctggcatgttctctggtacccaagaaaaatgcgctacctgcggcaaaacagcttatcctttggagaaggtaacagtggagaaccaagcataccacaagtcatgtttcaaatgttcgcacggagggtgttccttatctccatcaaattatgcagctttggagggaatcttgtactgcaagcatcatttctcacagctattcaaggagaagggtagctacaatcatctcatcgagtctgcatccatcaaacgcactgcagcagccacagcagcagcagcaacgccggaggccgcttctattccagaatgataatcattgcatgaaacggtttttggtttgtttgcgtcgcttgtgtttgttttaatgtttattattcccatgatagggaacggattaagctttgagacttgccaactttcttttgtgtgattgattcactgggtgcctgccatattaatcgaaactgtatttctgctt

SEQ ID NO: 282 - DNA, 790 bp, Lettuce
tgaaaattgaagagcattgaggaataatagatcaagaagggggaaagggtaactatgtcttttattgggacacagcagaaatgcaaagcttgtgggaaaacagtttatccggtggaacttttatctgctgatggtgttgattatcacaagtcatgctttaggtgtagccattgcaaaggtacccttaagcttagcaactactcatcaatggaaggtgtactatactgtaagcctcatttcgatcagctgttcaaggagagtggaaatttcaacaagaacttccaatcacctgcaaggtttgctgagaatttaacaccacatctgacgaaatcaccaagtaaagctgctgggatgttttccggcacccaagagaaatgtgcgacttgtggcaaaacagcttatcctcttgaaaaggtgacagtggagaacgaagcgtaccataagtcctgtttcaagtgctcccatgggggatgctcgttatctccatcaaattacgcagcgctagaagggattttatactgcaaacaccatttctcgcagttattcaaggagaagggcagctacaatcatcttattaagtccgcctccgtcaaacgctctgccgcagctacagctgcagcggccgtagcagccaccgctgttcctgaagcttgaaagttgaaataggattttgaaatctatgatcttacaaatagacggttgatttgttttgattttcattttcatttggcaatcgttgatgatcgatttcgatgggaaactgggtttgattgtattttacgatgactgt

SEQ ID NO: 283 - DNA, 1033 bp, Tripterygium
gagaccagacaaatatactcgaagggatattttttttctctctgtcatcgtcatccacttcgctgcatacggtcgctgcaaaagaggcgcctattccgcttttcggacaccataggagcgaatcgatagtttgggctcgatcgagctccatcagatccaccgttacttatttcgataagaagttgggttagatttgatctgtggaggtgatcttctggggatagaaattagccagatctaagggggttgggcagctatgtcttttattggtacccaagagaaatgcaaggcatgccaaaagactgtgtatcctgtggaactactatccgctgatggggttaattaccacaagtcttgcttcaagtgcactcactgcaaagggacactaaagcttagcaattattcctcaatggaaggtgttctgtattgtaaacctcactttgagcagctttttaaagaaacgggtaatttcaacaagaactttcagtcacccgcaaagtcagctgagaaattaactcctgagctgacaaggtcacctagcaaggcggccagcatgttttctgggacacaagagaaatgtgccacctgcaataaaaccgcttatccgctggagaaggtaacagtggagggccagtcctatcataaatcttgtttcaagtgctctcacggtggctgtcctatatctccatcaaattatgcagctcttgagggcattctgtattgtaagcaccatttttctcagctgttcaaagagaaggggagttacaaccaccttatcaagtctgcatcaatcaaacgtgcggcggcagcttctgttcctgaagcttgagttcaagttccttgcatacatctattccagtgtgttttttctctaaaccaagaggaactagcaagcacttggttcctctattgtctgttttatgattttctgttgtttggacatattgttgtggttgattgagctgtactcctacatatatatgtttgtagacctatgtttttgtgtttataacaaatcattaatgaaattgat

SEQ ID NO: 284 - DNA, 903 bp, Ambrosia
ttcttcttcttcttcccatctctgcaactaaatcataacagtcttgactttaatcaacaaagtcaactcaaatttcaacccatcaagactgttaatttattaagggaggtgaaggaaaagattaaggtcagatccaaagggaaaagggcaaatatgtcttttattggaacacagcaaaaatgcaaggcttgtgggaagactgtttaccctgtggagcttttgtctgctgatggtattgattatcataaatcttgcttcaagtgtagccattgcaaaggcacacttaagctgagcaattactcgtcaatggaaggagtgctctactgcaagcctcattttgagcaactcttcaaggagagtggcaacttcaacaagaacttcacatcacctgcaaaggctgctgataagttatctccaatgctgacaaagtcacctagcaaagctgctggcatgttctcgggtacccaagaaaaatgcgctacctgcggcaaaacagcttatcctttggagaaggtaacggtggagaaccaagcataccacaagtcatgtttcaagtgttcccacggagggtgctcgttatctccatcaaactatgcagctttggagggaatcttgtactgcaagcatcatttctcgcagttattcaaggaaaagggcagctacaatcatctcatcaagtctgcatccatcaaacgaacagcagcagccacagcagcagcagcagcaacgccagaggccgcttctattccagaatgagaatcattgcatgtaacggtttttggttgtttgcgttgcttgtgtttgttttaatgtttattgttcccatgctagggaacggattaagctttgagacttgccaactttcttttgtgtgattgattcactgggtgcctgccatattaa

SEQ ID NO: 285 - DNA, 993 bp, Cirsium
gcacatctcttctccagcattggttgatatataaatatcactcattcccaaagaaaaccccatttctttgcgctgcgtctaaacattccccactatttggcctctttattcctcttcatctctgcaaatcagaacaacttttgacttcgatcaacaaatccaactcaaatttgaaccaaattctctgaatttttatccaggtattggttgagattgaatctgaattgaaaagggtgagatataaagatttgaagatcagatccagaggggaaaagggtaattatgtcttttactggaacacagcagaaatgcaaggcttgtggaaagacagtttacccagtggagcttttgtctgctgatggtattgattatcacaaatcttgcttcaaatgtagccattgcaaaggtacccttaagctgagtaattactcgtcaatggaaggcgtgctctactgcaagcctcacttcgagcagctcttcaaggagagtggaaatttcaacaaaaacttccaatcacctgcaaagacagcagaaaagtcatctccaatgctgacaaagtcacctagcaaagctgctggcatgttctccgggacccaagagaaatgcgcgacttgtggcaaaacggcttatcctctagagaaggtaacagtggagaaccaagcataccacaaatcatgtttcaagtgctcccatggaggctgttctttatctccatcaaactatgcagcattggagggaatcttgtactgcaagcatcatttttcacagctattcaaggagaagggaagctacaatcatctcatcaaatctgcatctatcaagcggtctgcagcagcggcaacagcagcggcagcatcaccaaccaccgcctctattccagaagtttgaaaacacttgttatctatcatctttatgaacaaagtttttgatttgttttgcttgtgtttgtttttattggttatggttgatgattaaaactttgaaccctatcgg

SEQ ID NO: 286 - DNA, 802 bp, Cynara
  misc_feature (773)..(773): n is a, c, g, or t
attaagatttcagatcagatccagaggggaaaagggtcattatgccttttactggaacacagcagaaatgcaaggcttgtgggaagacagtttacccagtggagcttttgtctgctgatggtattgattatcacaaatcttgcttcaaatgtagccattgcaaaggtacccttaagctgagtaattactcgtcaatggaaggcgtgctctactgcaagcctcacttcgagcagctcttcaaggagagtggaaatttcgacaaaaacttccaatcacctgcaaaggcagcagagaagtcatctccaatgctgacaaagtcacctagcaaagctgctggcatgttctccgggacccaagagaaatgtgcgacttgtggcaaaacggcttatcctctggagaaggtaacagtggagaaccaagcataccacaaatcatgtttcaagtgctcccatggaggctgctctttatctccatcaaactatgcagcattggagggaattttgtactgcaagcatcatttctcacagctattcaaggagaagggaagctacaatcatctcatcaagtctgcatccatcaagcgctctgcagcagcagcaacagccgcagcagcaccaaccaccgcctctattccagaagtttgaaaacacttgttatcatcttatgaacaaagtttttggtttgttttgcttgtgtttgtttttattggttatggttgaagaatattcccatgccagggaactgattaaaactttgaacctatcggctttctntttgttgatttgatctttgctgagtgcca

SEQ ID NO: 287 - DNA, 866 bp, Guizotia
aacattggttcatatataaatataaaatatcacacatttctccaaaacccatttccttgcaacattccccacgatttgacctctgtgttcttcatctctgcaaatcagaacacacttttgactttcatcaacaaattcaactcaaatttcaacccaagactgtgaatttatccagggagttgaaagacaagatcagggtcagatctaaaggggaaaagggcaattatgtcttttattggaacacagcagaaatgcaaggcttgtgggaagacagtttaccctgtggagcttttgtctgctgatggtattgattatcacaaatcttgcttcaagtgtagccattgcaaaggcacccttaagctgagcaactactcatcgatggaaggtgtgctctactgcaagcctcactttgagcaactcttcaaggagagtggcaatttcaacaaaaacttcacatcacctgcaaaggctgctgagaagttgtctccaatgctgacaaagtcacctagcaaagctgctggcatgttctctggtacccaagacaaatgtgctacttgtggcaaaactgcttatcctcttgagaaggtaacagtggagaaccaagcgtaccacaagtcatgtttcaagtgctcccacggagggtgttcgttatctccatcaaactatgcagctttggagggaatcttgtactgcaagcatcatttctcacagctttttaaggagaagggcagctacaatcatctcatcaagtctgcatccgtcaaacgcactgcagcaacaaccgccgccgccgccgcagcagctgcttctattccagaatgattatgaaacaaagtttttggtttgttatgtgttgcttgtgtctg

SEQ ID NO: 288 - DNA, 815 bp, Beech
atttcttaaacttttcttgggttttagatcgagaagtgtcaaactctcagatccacccacttttattctctttcttcaggtgagaataatctttgaccctacgattttagttcttggagtagataaggttgttgttggaaaaggaatctgagcagaaagtgattttgaaaccgatccattgccttggaattggcagtaatattagtacttagagaagagtcagatccaaggcaatggctatgtctttcactggtacccaacagaaatgcaaggtctgtgagaagacagtttatccggtagagcagctatctgctgatggggttgtttaccacaagtcttgcttcaagtgctcccactgcaaagggacactaaagctcagtaactattcttcaatggaaggtgttctgtactgtaagcctcactttgagcagctcttcaaggagacgggcagtttcaacaagaattttcagtcacctgcaaagtcagctgagaagctaactccagagatgactaggtcacctagcaaagctgcgagcatgttttctgggacacaagaaaaatgtgcgacatgtggtaaaactgcttatccactggagaaggtgacagtggagagccagtcctatcacaagtcatgtttcaagtgctctcatggtggttgtccaataaccccatctaattatgcagcacttgagggcattttgtattgcaaacaccatttctcccagcttttcaaggagaaagggagctacaaccatcttatcaagtctgcatcattgaaacgcgcagcagcctctgtaccagaggcttaaacttga

SEQ ID NO: 289 - DNA, 1103 bp, Gossypium raimondii
tagtcatccacttcagcaccatctgctcgctgcaaaaagtacccttcttcaacaccaatctcctctctctctctctctctctattttgtttgataaatacccagaaaaccctttcagtcttctagctctcaatttctttttcttttttaccttcttatttcatagatccagggtgctcttcttcttagttcacattggcatagataaaggaccgtacggtcagatctaagccgtattctagcaatgtcgtttaccggtactcagcagaaatgcaaggcttgtgagaagaccgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactattcaaggagtcggggaatttcaacaagaatttccagtcacctgcaaagtcagctgagaagttaactcccgagctgacaagatcacctagcaaagctgccagcatgttttccgggacacaagaaaaatgcgctacttgtggaaaaactgcttatccactcgagaaggtaacggtggaaggacagtcgtaccacaagtcatgtttcaaatgctctcatggtggctgccctataactccatcaaattatgcagcacttgaaggcattttgtattgcaaacatcacttctcccaactttttaaggagaaaggaagctacaaccaccttatcaagtctgcatcgattaagcgcgcagctgcctccgttccagaagcttaaatccgtgtgttaatatccatatcatttcaagtttttccttctttcctcgtgattgccggtgtgtttgatttatgtttatgtgaggaccgaaacaaagacaaaacaaagaactgggttcggacatatctttcgggtttgctggttcatgagcatatatgtatgttatgatgtttgattgatgtatgggattgggatcattctgcattccccaagttgtaaaaacgaccattccacaatgttgaatgaatctatattcatgaaatttgttgaacaaaaagtaccgactgcgt

SEQ ID NO: 290 - DNA, 956 bp, Tripterygium
cgctacaaaagaggcgcctactcctctctttatgcacgctccataagagataatcgagagtttgagctcgaccgagttccatcagatccaccattactgattttgacaagaaattgtgttagattggatctgcggcggtgatttgtggagagagagattagccagatctaaggagatatagcagctatgtcttttattggtacccaagagaaatgcaaggcatgtcaaaagactgtgtatcctgtagaacttctatccgctgatggggttaattaccacaagtcttgcttcaagtgtactcactgcaaagggacccttaagctcagcaattattcctcaatggaaggtgttctgtactgtaagcctcactttgagcagcttttcaaagaaactggtaatttcaacaagaactttcaatcacctgcaaagtcagctgagaagttaactcctgagctgacaaggtcacctagcaaggctgccggcatgttttctgggactcaagagaaatgtgccacctgcaataaaaccgcttatccactggagaaggtaacagtggagggccagtcctatcataaatcttgtttcaagtgctctcatggtggctgtcctatatctccatcaaattatgcagctctagaggggattttgtattgtaagcaccatttctctcagcttttcaaagagaaagggagttacaaccaccttattaagtctgcatcaatcaaacgtgcagcggcagcttcagttcccgaagcttgagtttgagttccttacatgccatctattccagtgtgtttttttttttccaaaccaggaggaactagcaagaacatggttcctcttatcttcccgtgttttgggcatattgttgtggttgattgatttgtactccatctgtaaactgacttttggagggattgttggcgtgtggtatcttgttgaatattttcaattta

SEQ ID NO: 291 - DNA, 840 bp, Arnica
agggaggtaaaggagaagatcaagatcagatccaaaggggaaaagggcaattatgtcttttactggaacacagcaaaaatgcaaggcttgtgggaagacagtttacccagtggagcttttgtctgctgatggcattgattatcacaaatcttgcttcaagtgtagccattgcaaaggcactcttaagctgagcaattactcgtccatggaaggcgtgctctactgcaagcctcactttgagcaactcttcaaggagagtggcaatttcaacaaaaacttcacatcacctgcaaaggctgctgagaagttgtctccaatgctgacaaagtcacctagcaaggctgctggcatgttctccggtacccaagaaaaatgtgctacttgtggcaaaacagcttatcctctggaaaaggtaacagtggagaaccaagcctaccacaagtcatgtttcaagtgctcccatggagggtgttctttatctccatcaaactatgcagctttggagggaatcttgtactgcaagcatcatttctcacagctattcaaggagaagggcagctacaatcatctcatcaagtctgcatccatcaaacgcgctgcagcaacagcagcagcagcggcaacagcaacagcaaccgctgcttctattccagaatgataatcatcgtatgaaacagagtttttttgtttgttttgtcttgcttgtggttgcttttaatggttattgttcccatgtcagggaacggattaagctttgagacttaccaactttcttttgtgtgattgattcactgggtgcctgccatattaatcaaaaacttatttctgctctaaaaaaaa

SEQ ID NO: 292 - DNA, 1012 bp, Dandelion
ccgggcagcattgcttgatatataaatatcacacaggttccccacaaaaacccatttctttgcgctgcgtcttaccttctcagacattccccacaatttgacctctgcaaaccagagcgattttgacttcgatcgacaaatccaagtcaaaatctaacaaaagtctctgaaatttatcaagggaggtagaggaaaagatcaagatcagatccattgcggaaaggggcaattatgtcttttatgggaacacagcaaaaatgcaaggcttgtgggaagacagtttacccagtggagcttttgtctgctgatggtatcgattatcacaaatcttgcttcaagtgtagccattgcaaaggtacccttaagctgagcaattactcatcaatggaaggcgtactctactgcaagcctcactttgagcagctttacaaggagagtggaaatttcaacaaaaacttccaatcacctgcaaagacagttgacaagtcatctccaatgctgacaaagtcaccaagcaaagctgctggcatgttctccgggacccaagagaaatgtgctacatgtggcaaaacagcttatcctctcgaaaaggtcacagtggagaatcaagcgtaccacaagtcatgtttcaagtgttcgcatggagggtgttctttatcgccatcaaactatgcagcattggagggaatcttgtactgcaagcatcatttctcccagcttttcaaggagaagggaagctacaatcatctcatcaagtccgcatccatcaagcgatctgctgcagcagcgaccgcagcagccgcatccgcagctgttgcttctattccggaagcttgattgcatgcaaattgttgtgttttatcttcttaccaacaaaattttcggtttgttttggttgtgtttttttttttgggttcttgtttgatgattaagctttcagacttaacaagacttccttttgtttgattggttggttgtgggtgcccgtatttatctaaacaaatttccactc

SEQ ID NO: 293 - DNA, 1042 bp, Sunflower
gcttgatatataaatataaaaatatctcacattctccaaaaccaaaaaaaaaaaaacccaattctttgcgctgcgtctaacattccccacaatttgacctctgtgttcttcatctctgcaaccaaatcagaaccattttgacttttttatcaacaatttcaactcaaatttcaacccaagactgttaatttattaagggaggtgaaggatttaagatcaggtataaagatttaagatcaaggtcagatctaaaggggaaaagggcaattatgtcttttattggaacacagcagaaatgcaaggcttgtgggaagacagtttaccctgtggaacttttgtctgctgatggtattgattatcacaaatcttgcttcaagtgtagccattgcaaaggtacccttaagctgagcaattactcgtcaatggaaggagtgctctactgcaagcctcactttgagcaactcttcaaggaaagcggcaacttcaacaagaacttcacatcacctgcaaaggctgctgagaagttgtctccaatgctgacaaagtcacctagcaaagctgctggcatgttctccggtacccaagacaaatgcgctacttgtggcaaaacagcttatcctctggagaaggtaacagtggagaaccaagcataccacaagtcatgtttcaagtgctcacacggaggatgttctttatcgccatcaaactatgcagctttggagggaatcttgtactgcaagcatcatttttcgcagctattcaaggagaagggcagctacaatcatctcatcaagtcggcatccatcaaacgcactgcggcagccgcagccgcagcagcaacaccagatgccgcttctattccagaatgataaccatcgcatgaaacggtttttggtttgttttgctttgcttgtgtttgtgtttaagtgtttattattcccgcgcttgggaacggattaagctttgagacttaccaactttcttttgtgtgattgattcactgggtgcctgccgtattaatcgaaactgtatttccgctttt

SEQ ID NO: 294 - DNA, 977 bp, Cotton
taaatacccagaaaaccccttcagtcttctagctctcaatttctttttattttttaccttcttatttcatagatccagggtgctcttcttcttagttcacattggcatagataaaggaccgtacggtcagatctaagccgtattctagcgatgtcgtttaccggtactcagcagaaatgcaaggcttgtcagaagaccgtttatcctgtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactattcaaggagtcggggaatttcaacaagaatttccagtcacctgcaaagtcagctgagaagttaactcccgagctgacaagatcacctagcaaagctgccagcatgttttccgggacacaagaaaaatgcgctacttgtggaaaaactgcttatccactcgagaaggtaacggtggaaggacagtcgtaccacaagtcatgtttcaaatgctctcatggtggctgccctataactccatcaaattatgcagcacttgaaggcattttgtattgcaaacatcacttctcccaactttttaaggagaaaggaagctacaatcaccttatcaagtctgcatcgattaagcgagcagctgcctccgttccggaagcttaaatctgtgtgttaatatccatatcatttcaagtttttccttctttcctcgtgattgccggtgtgtttgatttatgtttatgtgaggaccgaaacaaaaacaaaacaaagaactgggttcggacatatctttcgggtttgctggttcatgagcatatatgtatgttatgatgtttgattgatgtatgggattgggatcattctgcattccccaagttgtaaaaacgaccattccacaatgttgaatgaatctagattca

SEQ ID NO: 295 - DNA, 1031 bp, Cotton
cgctagtcggttactttttctttttttctctttgctttggtagataaatacccagaaaaccctttcagtcttctagctctcaatttctttttcttttttaccttcttatttcatagatccagggtgctcttcttcttagttcacattgacatagataaaggactgtacggtcagatctaaaccgtattctagcaatgtcgtttaccggtactcagcagaaatgcaaggcttgtgagaagaccgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacctgcaaggtcagctgagaagttaactcccgagctgacaagatcacctagcaaagccgccagcatgttttccgggacacaagaaaaatgtgctacttgtggcaaaactgcttatccactcgagaaggtaacagtggaaggacagtcgtaccacaagtcatgtttcaaatgctctcatggtggctgccctataactccatcaaattatgcagcacttgaaggcattttgtattgtaaacatcacttctcccaactttttaaggagaaaggaagctacaaccaccttatcaagtctgcatcgattaagcgcgcagctgcctccgttccagaagcttaaatccgtgtgttaatatccatatcatttcgagtttttccttctttcctcgtgattgccggtgtgtttgatttatgtttatgtgagaaccgaaacaaagacaaaacaaagaactgggttcagacatatatttcgggtttgctggttcatcagcgtatatgtatgttatgatgtttgattgatgtatgggattgggatcattctgcatcccccaagttgtaaaaacgaccattccacaatgttgaatgaatctatattcaaaaaaaaaaa

SEQ ID NO: 296 - DNA, 1248 bp, Grape
cctctctctatctctctctttctttctttctctatcatcatccactacttcgcagcatccgctccctgcaaaaagcgtccaatcctctttctcccgctctcttttacgtcagcttggattttgattctccaaatcgcctctgaatctttaatttctggctgttgattaagaccttcatttctgaagacctcacggatcaacgatttctggcttgtttagttttctgagcagctgagggaaaggcaaatctaagcatatatttccgaagccaatctcgcatttccgaatcggataaaaagtcggatctaaggcacgcacaattatgtctttcattggcacacaacagaaatgcaaggcgtgcctgaagactgtttatccggttgagcagttgtctgctgatggagtggtttaccataaatcgtgcttcaagtgctctcactgcaatgggacacttaagctgagcaattattcctcaatggagggtgttctttactgtaagcctcactttgagcagctctttaaggagtctggaaatttcaacaagaattttcagtcacctgcgaagtcagctgagaagttaactccagagctgacaaggtcacccagcaaagctgccagcatgttttctgggacacaagagaaatgtgcaacctgtggtaaaacagcttatccacttgagaaggtaaccgtggagagccaggcttatcacaaatcatgtttcaagtgctcccatggtggctgcccaatatccccatcaaattatgcagcccttgagggcattttgtattgcaaacaccattttgcccagcttttcaaggagaaaggaagctacaaccatctaattaagtccgcatcaatgaagcgctcagcagcctctgttcctgatgcttgaactccataacaatattttatcctctaattacatggctttgttttgtttttgggtgtgttttctttagattttgccatgatttccagggtgagaaactgtcaaagacgatactgttctcttgtccttgttttctgctcatccgtgttgtcatctttgtgtttgatttatgggaatgtgcattcccacagttgtgaaatgaactttattaccaagagtgactgttgttagctcctgttttgtgccgttgcaaaaacgaacaaatgaaagcaggaaaacacaaaggtttatcctgtttcatacatatcaaatgagttggtcatagccacaaaataaataaaattgcttgcatttatttg

SEQ ID NO: 297 - DNA, 1246 bp, Kiwi
tcttactctatccctgtcatcgtcaacttcgctcggtcgctgcakccgctccctgcasaaaccctcccatcgctctcgctctctttatcccctctctctctctcctatctatctatctctatctccctacgcaccgtaagagaattccatattcgattttcgtcggttctcattcttaactttgatcgagaactctttttctcacggatcaacattctctatcttcaggatctgcctttgtttgggaacaattggagttgatctcagaataatagataaaaattcatagttatgtctttcaccggtacgcagcagaagtgcaaggcctgtgagaagactgtttacccggttgagcttttgtctgcagatggggtttcttatcacaaatcgtgctttaagtgcagtcactgcaaaggaacgctcaagctgagcaattattcctcgatggaaggtgttctatactgtaagcctcacttcgagcaactcttcaaggagacgggtagtttcaacaagaatttccaatcacctgcaaagtcagctgacaagttaacaccagagctgacaaggtcgcctagcaaagctgccagcatgttttctgggacgcaagaaaaatgtgcaacatgcggtaaaacagcttatccactggagaaggtaactgtggagagccaagcctatcataagacgtgttttaagtgctctcatggtggctgctctataacaccgtcaaattatgcagccctagagggcattttgtactgcaaacaccatttctcccagctttttaaggagaaagggagctacaaccaccttctcaagtccgcatcaatgaagcgcccaaycgcctctrttccagaagcgtgaactctatatccttatttattatctatttttgcatgggcttcttgtacttgtgtgtgtatctttgtgatttctattccagaaactgacgatgtgggtcgtctgattcttattttctgccgtttgtttggcatcttcttgtttggttgatacgcaggtttcgcatttatcctatttctgaaatgacgtgtggcaaggactcacatgccaatgtggctcttaggggcttttcttctttcatgttttgcattttttttcttcctcttcttctttccttatttggccttttctgggcaggactcgcctgtcaatgtggttgttattggccttgtggttctatagaagttcaaatgaatcgtttccaaatgctgtttccaaaaaaaaaaaa

SEQ ID NO: 298 - DNA, 1743 bp, Watermelon
acgtcgttactctgcagaatgccgatggtggagctccagtactcaaaaagttgaagaacaaagtagcaccgggacggagtaaagttgaagcaagcaatgtgtgtctttccggcaaagatattttctcagatcccttttcactttatctccttccttttttttctctataaagaaaatcgacgctgtgaataatctatcctaaattatttgtttctgcctttcgctttatctttcatttcattatcttttccttctctgctccacttgctataaccaaatacattcgctgcattttgttactttcatgatttgagaggtacccatcttcgatttcgattgcatttcagctttgatcaagatcttgttccttcagctttctgggttaatcaacttttctgggtttgatccttttagctcatcgatttgattttctgaaattcccagctcattggttgcagattttttttttttttttttaaattattattctgaatttgattctgggtttttgtggtttgattgtgtttgatgaaatgacgataggagaaaggagtttgtttgatcgggatagcttggtggctttgtattggaggagattctggttggttgagaatagtcagatctactctaaggctttttagctatgtcgtttattggtacccaacagaagtgcaaagcttgtgagaagactgtgtaccctgtagatcagttatctgctgatggagttgctttccacaagtcatgtttcaaatgtagccattgcaaaggaactcttaagctgagtaattattcttcaatggaaggtattctgtactgtaagcctcattttgagcagctcttcaaggaaaccggcaacttcagcaaaaactttctgtcccctgcaaagtcctccgagaagccaactccagagctgactaggtcaccaagcaaagctgccagcatgttttctgggacacaagaaaaatgtgcaacatgtggaaaaactgcatacccactggagaaggtgacagttgagagtcaagcctatcacaagtcgtgttttaaatgctcacacggtggctgttctttatctccatcaaactatgctgcacttgatggaattttgtactgcaaacaccacttttctcagcttttcaaggaaaagggaagctataaccatctgatcaaatctgcatcgatgaagcgtcaagcagcaacctccgatctggatccttcaaaggtcgagtcataaacttccaatttgtggttttgttgagtccattttccctctgctttcctcccttccccagtgtgttctactttgatcctcacaatttcgtgatgggaaacaaaaaaggaaacttgcacgagtctccagctcgtcgtgttgagccaaattgtttgtttgctagattcatggaacttcaaacaaaccatttgaaattgggcaatgatttgctaaactttatgaaagcattttgcaacatttcgttttgggttaccagaagatcgaaatggagtcattctgtttcctgcttaattcctctatgttttcatgttgacaagtacttcaagtggtttagaaaacttctctctcatcttgatatcagttggaaatgacctaaatcataggctgcatagctatcttctatatgtctttggttatcaaaggcaatattggaggacctaacttgccttgctgcccccctgaagaagtgtaaaaaccaattattttctctataatcaatctacacatgggatggg

SEQ ID NO: 299 - DNA, 1126 bp, Artemisia
agtactccaacggggaagctgcaaaaagcacatctttttacccacaatatataaataaaaatatctctcatttccctcataaaaaaaacctgcatatcaaacattccccacaatttgatcagaaaacaatctttgactttaatcaactcaaatttcatccaaactctctcatttcatcaagggtaagctcagatctgaagggtaaaaagggtaaaaatgaattttactggaacacagcagaaatgcaaggcttgtgggaagacagtttaccctgttgagcttttgtctgctgatggtattgattatcataagtcttgcttcaagtgtagccattgcaaaggtacccttaagctgagcaattactcttcaatggaaggtgttctctactgcaagcctcactttgagcagctcttcaaggagagtggcaatttcaacaaaaacttcacatcacctgcaaaggcggctgactctccaatgctgacaaagtctcctagcaaagctgctggcatgttctcggggacccaagacaaatgtgctacttgtggcaaaaccgcttatcctctggaaaaggtaacagtagagaaccaagcttaccacaagtcgtgttttaagtgctcccatggaggctgctctttatctccatcaaactatgcagctttggagggaatattgtactgcaagcatcatttctcgcagctatttaaggagaagggcagctacaatcatctgatcaaatctgcatccatcaaacgcaatgctgcagcaactgcagcagcagcaacagcagctgccgcttctattccagaataaacacgtgctatctcatcatacgaacagagttttttggtttgtttggttgtgtttgttgttattggttattgttgatgattattcccaatgccagggaacggattaagctgtaagacttgtcaactttcttttgtttgattgattcgctgggtgtctgccatatttatctaaacatatttctgatgttctctaaacttgagtaacatgtagtttcaatgttattgtgatttggagtatagccaaactaggagaaaatgcaatgtactattcgcttcttaataaaaaaaaaaaaaaacaatagtcggagtctagaata

SEQ ID NO: 300 - DNA, 1068 bp, Lettuce
aagccatctcttccccgcattggttgatatatataaatatcacacagttccccaaaaaaacccatttctttgcgctgcgtctatccttctcagacattccctacaatttgacctctgaaaacagaaggattttgacttcgatcgacaaatccaactcaaatttcaacaaaactatctgaatttatcacaggtgttggttcagattgaattgaattgaaaagggtataaaggtttcacatctgattggttgttgacaatagggaggtagaggaaaagatcgagatcagatccataggggaaaagggcaattatgtcttttaccggaacacagcaaaaatgcaaggcttgtgggaagactgtttacccagtggagcttttgtctgctgatggtattgattatcacaaatcttgcttcaagtgtagccattgcaaaggtacccttaagttgagcaattactcatcaatggaaggtgtgctctactgcaagcctcactttgagcagctcttcaaggagagtggaaatttcaacaaaaacttccaatcacctgcaaaggcggctgagaagttatctccaatgctgacaaagtcaccaagcaaagctgctggcatgttttcggggactcaagagaaatgtgctacttgtggcaaaactgcttatcctctcgagaaggtaacagtggagaatgaatcataccacaagtcttgtttcaagtgctcccatggaggctgttctttatctccatcaaactatgcagcattggaggggattttgtattgcaagcatcatttctcacagctcttcaaggagaaggggagctacaatcatctcatcaagtctgcatccattaagcgagcatcagcagcatcagcagcagcagcaacagcagctgcagcttctatcccagaagtttgaagtttgaaacacctacaaattcatgatgttcatcttctacttaccattttccaacaaagttttcggcttgtttttgcttgtggttgtcttttaatgccgtttgatgagaaaagctttcctttcgacttattgacttccttttgtttgattggttg

SEQ ID NO: 301 - DNA, 1547 bp, Cacao
agcattcagttaaaaagtgttggtgtctcacaacgaacaaagggtcaacgttgtcaatttaggctcagaacacagcaaaagccgcctacgcctagttgggattttggttggaggttgaaagcaagacagggcaaagccgaaccctgttccatccagcaaaacacagagattttttttctttctctttttaagtcccaataattcctcattatcccaataactcctcattatctctctttcatcattctctctctctcctagactcaatcatcatcatcatccacttcagcagcatctgctcgctgcaaaaagtacccaatcccacctcctctctttgtctttctcttttttgggtccttaaatccccagaagaccctttgactctttacctttcatttccatcttatttcacagatccgggtctttttcttcttcttctatcaaggtacatgttttgttattgcttttttcaagtttcaatctttaacccagtttttgttcatagctgtcattatcatttggtcattctttttgggtgcttttcctttgcttaaatattggcaaatataaggcaggaaattggattaaagctgatctgttgaattagataaagaacagtacggttagatctaaagcatattctagccatgtcttttactggtacccagcagaaatgcaaggcttgtgagaagactgtctatcctgtggaacttttgtcagcagatggggttccttaccataagtcttgcttcaaatgcagtcattgcaaagggactctaaagttgggtaattactcctcgatggaaggtgtcctttattgcaagcctcattttgagcaactcttcaaggagacgggtaacttcaacaagaattttcagtcaccagctgcaaagtcagctgagaagttaactcccgagctgacaagatcacctagcaaagctgccagcatgttttcagggacacaagaaaaatgtgctacttgtggcaaaactgcttatccacttgagaaggtaacagtggaagggcagtcctaccacaaatcatgcttcaagtgctctcacggcggctgccctataagcccctcaaattatgcagcccttgaaggcattttgtattgcaaacatcacttctctcagcttttcaaggagaaaggaagctacaaccatctcatcaagtctgcatcaattaagcgtgctgcagcctctgttccagaagcttgaatacattcactattcatattgttttcatgtatttttcttctttcccgtgcttgccggtgtgatttttcttatcgatcctctctgatattatgtttacggggaacaaaaaagaactcgaggttcctctctggtttcacttcctgcgtatatgttatggtatttgattgatcttatgggattgggatgtgcattccccaagctgtagaacgacccttgcatgatactgtatgtagaagtggatgttgtttacaccttttccattttcttcagtcatcaacatatgatccatgcaatgttacgactttagtattaaaaagaaattatccc

SEQ ID NO: 302 - DNA, 1026 bp, Flaveria
caaaaagcacatctcttccacaacattgcttcatatataaatataaaaataaatatctccaaaacccaatttctttacaacattccccaaaatttgacctctgtgttcttcatctctgcaaatcagaacaattctgactttgattcacaaattcaactcaaatttcaaccaaagattgtaactttatcaagggaggtaaaaaagagaagatcaagatcagatccaaagggtaaaagactaaaaggggtaagtatgaattttactggaacacagcaaaaatgcaaggcttgtgggaagacagtttaccctgtggagcttttgtctgctgatggtgttgattatcacaagtcttgcttcaagtgtagccattgcaaaggtacccttaagctgagcaactactcatcaatggaaggcgtgctctactgcaagcctcactttgagcaactcttcaaggagagtggcaatttcaacaaaaacttcacatcacctgcaaaggctgctgagaagttatctccaatgctgacaaagtcacctagcaaagctgctggcatgttctctggtactcaagagaaatgtgctacttgtggcaaaacagcttatcctctggagaaggtgacagtggagaaccaagcgtaccacaagtcatgtttcaagtgctcccacggagggtgttctttatctccatcaaactatgcagctttggagggaattttgtactgcaagcatcatttctctcagctattcaaggagaagggcagctacaatcatctcatcaagtctgcatccatcaaacgcactgcagcaacaactgcagctgcagcggcagcggccgcttcgattccagaatgataatgatcatgtgaagctaaagtttttttggtttgtttgttttgctcgtgtttgtttttaatgtttattgttcctgttccatgttaggaaccgattaagctttgagacctaccaactttctattgtgtgattgatttcactgggtgcctgccatattaatcaaagacttatttctgc

SEQ ID NO: 303 - DNA, 1054 bp, Flaveria
atggggattatcaatcctcttcgctccatccactacgctgcaaaaagcacatctcttccacaacattgcttacatatataaataataaaaataaaatatctccaaaaccccatttcttacaacattccccaaaatttgacctctgtgttcttcatctctgcaaatcagaacaattctgactttgatccacaaattcaactcaagtttcaaccaaagattgtaactttatcaagggaggaaaaaaagagaagatcaagatcagatccaaagggtaaaaggggtaaatatgaattttactggaacacagcaaaaatgcaaggcctgtgggaagacagtttaccctgtggagcttttgtctgctgatggtgttgattatcacaaatcttgcttcaagtgtagccattgcaaaggcacccttaagctgagtaactactcatcaatggaaggcgtgctctactgcaagcctcactttgagcaactcttcaaggagagtggcaatttcaacaaaaatttcacatcacctgcaaaggctgctgagaagttatctccgatgctgacaaagtcacctagcaaagctgctggcatgttctctggtacccaagagaaatgtgctacttgtggcaaaacagcttatcctctggagaaggtgacagtggagaaccaagcgtaccacaagtcatgtttcaagtgctcccacggagggtgttctttatctccgtcaaactatgcagctttggagggaattttgtactgcaagcatcatttctcacagctattcaaggagaagggcagctacaatcatctcatcaagtctgcatccatcaaacgcactgcagcaacaactgcagctgcagcagcagcggccgcttctattccagaatgataattatcgtgtgaagctaaagtttttttggttgtttctctttgctcgtgtttgttttcgatgtttatttgttcctgttcccatgctagggaaccgattaagctttgagacctaccaactttctattgtgtgattgatttcactgggtgcctgccatattaatcaaagact

SEQ ID NO: 304 - DNA, 1467 bp, Eucalyptus
cgagaaaacagggaagccgcgtcaggaaagagagttggttgaatcagatcgagtgtgggagccagtgtgggagccatttttttgcttccgcccaacttcactgatattttcctccttccttttcttttaatttctctctctctctctctctctcaaaagaagagaaggccaaaaaggaaaaaaaagaaaggaaaataattaccaccatcatcagcatcatcatcatccacttcgctgcatccgctccccgcaaaaaagagcgaccattctctctctctctctctctctctgtgaagatcctctctagcgataaatcactgttgcccatttcttccttggctccgttctgttgcttcctctctctgtcttcgacacttcagctcgtgcgagcccaaaaatcgatccttttctgcttccttttgcctctgttccagctgtggtcgagtaagcaggaatcaattgatactgggtcgatctggtcggcaacttttgttggaagtttgaggaatctgatcgagagaagaggtagatctaaaggatcaaaaggatgtcatttaccggcacccaagttaaatgcaaggcttgcgaaaagacagtttatcctgttgaacagttatctgcggatggggttgcataccacaagtcttgcttcaagtgcagccactgcaaaggcacattaaagctgagcagctactcctcaatggaaggagttctatactgcaagcctcactttgagcagcttttcaaggagactggtaatttcaacaagaactttcagtcacctgcaaagtcagctgacaagttaactccagagctggcaagatcacctagcaaggctgctggcatgttttctggtacacaagataaatgtgcaacttgtggcaaaactgcctatccactggagaaggtaacagtggagagccagagctatcacaaatcatgtttcaagtgctctcacggaggttgccccataaccccatcaaactacgcagctctggagggcatcttgtactgcaaacaccacttctcccagctttttaaggagaaaggaagctataaccatctcatcaagtctgcatctatgaaacgggctgcagcatcaattccagaagcttaaaatgacctttcttatgatgtttcttgtgcgattattgggtcggtcttgatgtgtgccttttgtttgtctagcttgttcatcttgggggagctaatgaacttggttcctccgtttctgctttccgcaaatcctgtgacaagccctttcttatgttgtgatggataatagagtccgaggttgtgaattgacatttttattgaaccgcagatatgagtttcggacaatcttgttgcagtttgcttttccgtttgcaagcttgtgctactgaaattacgtgtcttatttccctttttcctaacaagctgtagtttcccagatgagcagccaagttcgtgaggtgccttttccat

SEQ ID NO: 305 - DNA, 1068 bp, Ipomoea nil
catcatccacttcgccatctccaaattctctctctcctcgaagatatataacggaacgtcgtacgcagagtcgcggagtgattcttagttcaaggtttcccaaatagtttggatccgacgtttcgccttgtttttctggaactccactctgatctgcagaagcacaagctggtagatcaagaactcccttttttcttcaaggtttgaagggtcagatctggactttgcttttgagggattttaggagcacaaaaaagagaatgtctttcattgggactcagcagaaatgcaaggcttgtgagaagacagtttatcctgtggagctgttgtcagctgatgggattaattatcacaagtcttgcttcagatgcagccattgcaaaggcacccttaagctgagtaattactcctcaatggaaggtgttctgtactgtaagccccatttcgagcagctcttcaaggaatcagggaatttcaataagaattttcagtcacctgcaaagtcggctgacaagttaaccccagagctgacaaggtcccctagcaaagctgccagcatgttctccgggacacaggaaaaatgtgctacttgtgggaagacagcttaccctctggagaaggtgacagtggagaaccaatcctaccacaagtcgtgttttaaatgttctcatggtggatgctctttaactccctcgaactatgcagcactggatggaatcttatattgcaaacctcatttctcccagctattcaaggagaaaggtagctacaaccacctaatcaagtcagcctcggtgaagcgcccgacaactccagttcctgaagcttgaaaatctcttccccttcttcgttatttctctactggccatttgccttctttctttctttctttctttcggtgtgtttcctcgctctctttttacctctggccagtagcataaccgactactttcacaattgagactctcggagtgtttaatataccttgtggtgtgagatgggttttgtccttgattatgacataagttctgctgtcactagtcccttccaatggttggggctgtacat

SEQ ID NO: 306 - DNA, 854 bp, Lettuce
ccttctcagacattccccacaatttgacctctgaaaccagaaggattttgacttcgatcgacaaatccaactcaaatttcaacaaaactctctgaatttatcaagggtgttggttcagattgaattgaattgaaaagggtataaaggtttcacatctgattggttgttgacaatagggaggtagacgaaaagatcaagatcagatccatagggggaaagggcaattatgtcttttaccggaacacagcaaaaatgcaaggcttgtgggaagactgtttatccagtggagcttttgtctgctgatggtattgattatcacaaatcttgcttcaagtgtagccattgcaaaggtacccttaagttgagcaattactcatcaatggaaggcgtgctctactgcaagcctcactttgagcaactcttcaaggagagtggaaatttcaacaaaaacttccaatcacctgcaaaggcagctgacaagttatctcctatgctgacaaaatcaccaagcaaagctgctggcatgttctcgggaactcaagagaaatgtgctacttgtggcaaaactgcttatcctctcgagaaggtaacagtggagaatgaatcataccacaagtcttgtttcaagtgctctcatggaggctgttctttatctccatcaaactatgcagcattggaagggattttgtattgcaagcatcatttctcacagctgttcaaggagaagggaaagtacaatcatctcatcaagtctgcatccattaagcgctctgcagcagcaacagcagcagcttctattccagaagtttaattcatctttctaccatttaccaaaaaaagttttcggcttgttt

SEQ ID NO: 307 - DNA, 1076 bp, Tragopogon
acgctgcaaaaagcaaatctcttccccagcatttgttgatataaataaaacgcacttccccgaaaaaatccaattcttttcgctgcgtcttaacccactcagacattccccacaatttgacctctgtaaatcaatcaactttgacttcgatcaacaattctaactcaaatttccatcacaatctctgaattcatcaagggaggtagagaaagaaaagaaaaagatccaagatcagatccataggggaaaagggcaattatgtcttttaccggaacacagcaaaaatgcaaggcttgtggaaagacagtttacccagttgagcttttatctgctgatggtgttgattatcataaatcttgcttcaagtgtagccattgcaaaggtacccttaagctgagcaattactcatcaatggaaggtgtgctctactgcaagcctcacttcgagcagctcttcaaggagagtggaaatttcaacaaaaacttccaatcacctgcaaaatcagctgagaagttatctccaatgctgacaaagtcacctagcaaagctgccggcatgttctccggtacccaagagaaatgcgctacttgtggcaaaacagcttatcctctcgaaaaggtaacggtggagaatcaagcgtatcacaagtcgtgtttcaagtgctcgcatggcggttgttctttatcgccgtcaaactacgcagcattggaggggattttgtactgcaagcatcatttttcgcagctgttcaaggaaaagggcagctacaatcatttgatcaaatctgcatccatcaaacgatctgcagcagccgccactgcagcagcagccgtcgattctattccagaagtctgagaccacgtgctaattcatatcatcttaccgatttgttttgcttgtgtttgttttcattggttcatgatttaagccttggacttatttcactttcttttgtttgatgattcgctgagtgcccatatttatttaaaaccatattttcactcttcttgaatttgagttcaaccttttggtgtcataaaaatttattctttcagacaaaaaaaaaaaaaaaagta

SEQ ID NO: 308 - DNA, 823 bp, Flaveria
aaaaaagagaagatcaagatcagatccaaaggttaaaaggggtaattatgaattttactggaacacagcaaaaatgcaaggcttgtgggaagacagtttatcctgtggagcttttgtctgctgatggtgttgattatcacaagtcttgcttcaagtgtagccattgcaaaggcacccttaagctgagcaactactcatcaatggaaggcgtgctctactgcaagcctcactttgagcaactcttcaaggagagtggcaatttcaacaaaaacttcacatcacctgcaaaggctgctgagaagttatctccaatgctgacaaagtcacctagcaaagctgctggcatgttctctggtacccaagagaagtgtgctacttgtggcaaaacagcttatcctctggagaaggtaacagtggagaaccaagcataccacaagtcatgtttcaagtgctcccacggagggtgttctttatctccatcaaactatgcagctttggagggtattttgtactgcaaacatcatttctctcagcttttcaaggagaagggcagctacaatcatctcatcaagtctgcatccatcaaacgcactgcagcaacaacaacagctgctgctgcagcagcggccgcttctattccagaatgataatcatcgtgtgaagcaaagttttttggttgttttattttgctcgtgtttgtttttaatgtttattgttcctgttcccatgctagggaaccgattaagctttgagacctaccaactttctactgtgtgattgattcactgggtgcctgccatattaatcaaagacttatttctgc

SEQ ID NO: 309 - DNA, 916 bp, Flaveria
aaatatctccaaaacccatttctttacaacattccccaaaatttgacctctgtgttcttcatctctgcaaatcagaacaattctgactttgatccactaatttaactccaatttcaaccaaagattgtaactttgtcaagggaggtaaaaaggagaagatcaagatcagatccaaagggtaaaagactaaaaggggtaagtatgaattttactggaacacagcaaaaatgcaaggcttgtgggaagacagtttaccctgtggagcttttgtctgctgatggtgttgattatcacaaatcttgcttcaagtgtagccattgcaaaggcacccttaagctgagcaactactcatcaatggaaggtgtgctctactgcaagcctcactttgagcaactcttcaaggagagtggcaatttcaacaaaaacttcacatcacctgcaaaggctgctgagaagttatctccgatgctgacaaagtcacctagcaaagctgctggcatgttctctggtacccaagagaaatgtgctacttgtggcaaaacagcttatcctctggagaaggtgacagtggagaaccaagcgtaccacaagtcatgtttcaagtgctcccacggagggtgttctttatctccgtcaaactatgcagctttggagggaattttgtactgcaagcatcatttctcacagctattcaaggagaagggcagctacaatcatctcatcaagtctgcatccatcaaacgcactgcagcaacaacaactgcagctgcagcagcagcggccgcttctattccagaatgataattatcgtgtgaagcaaagtttttttggttgtttatttgctcgtgtttgttttaacgtttatgttcttgttcccatgctagggaaccgcttaagctttgagacctaccaactt

SEQ ID NO: 310 - DNA, 890 bp, Sarracenia
acagatcaacgagtttctatcttcagttaatttggtttgagaggcgaatctaagcaggaaaaaaggggggggaaccgaattggtgttggtatcacagcaatagacaagagttcataattatgtctttcaccggcacacaacagaagtgcaaggcttgtgagaagacagtttatccagtcgagcttttatctgctgatggagtttcttatcacaagtcatgcttcaagtgcagtcactgcaaaggaacgctcaagctgagcattactcctcgatggaaggtgttctatactgcaagcctcactttgagcagctcttcaaggagaccggtagtttcaacaagaatttccaatcacctacaaagtcagctgaaaagttgacacctgtgctgacaaggtcacccagcaaagctgccagcatgttttctgggactcaagaaaaatgtgcaacatgcggtaaaacagcttatccactggaaaaggtaactgtggagagtcaggcctaccacaaatcatgttttaaatgctcccatggcggctgtgcgatatctccgtcaaattatgcagcccttgagggcattttgtattgcaaacaccatttctcccagctttttaaggagaaagggagctacaaccatctcctcctcaagtctgcatcggtgaagcgcccaacggcctctattccagaagcttgaactctatattcttataatcttttttttttccttctttttgtgtgtggacctgttttgctcaattgtgtatctttgtgatttctctttttgagttctgagttggaacacagacaactcgccaactcggggcttcaagcttcttattttctggcatttgattggcatcttgttgttttggttgaaatgtgagattcattca

SEQ ID NO: 311 - DNA, 1175 bp, Oil palm
cccttacttcccccgttcgttcggttcggtcccgtttcgggtcctacgttcttcctacgtttttttttacttttcgtcctccctcctctcgggacgcaacgcgcagacccccttcgcttcttatttctctttcccagctcctccattccaatttttatccccaggttttgctcggaataacgaagcgaacccgtcgtcggccatttcgctccctcatttttctgagatcttgtcattctttttttattatttttcgaggattggatctaaggattttggtggccatcagtctgtagatctctggacgcaggtttaggaggtccgagaagatacttgggcgtctattttgaaaagtatcaggtcgtgtagatcgcggaccgtctgatccagaatcgatggctttcagcggcacgcagcagaagtgtaaggcctgcaacaagacggtctacctgatggaccagttgtccgccgatgggatcgcctatcacaagtcctgcttcaagtgcaatcactgcaaaggaaccttaaagctgagtaattattcttcactggaaggtgtcttgtattgcaaacctcattttgagcagcttttcaaggagacaggcagtttcaacaagagctttcagtctcctgcaaagtcagctgagaagttaactccagagctgactagatctcctagcaaagctgctggcatgttttcaggaactcaagaaaaatgtgccacttgtggcaaaacagcttatccgcttgaaaaggtgactgtggaagggcaagcatatcataagtcttgtttcaagtgctcccatggaggctgtcccattagcccttcaaactatgcagccctcgaaggcatcctctactgcaagcaccacttctcacagcttttcaaggagaagggggagttacaaccatctcatcaaatgtgcttccatcaagcgcacagcagcatccaccccagatctctgagttcattctgtttactgaaatggattttcacccaagtgtgcgatctcatcatatatttttgattttggatgcttccatcctttctgcttgttcaattgaggaattggcaaactcgcattcctctgttttgttaatttcttgtgtgaaatctataaccatgccaaaccataaaaactggtatttcttattcaatgcatgtgatgcgtgtt

SEQ ID NO: 312 - DNA, 1164 bp, Phlya
ccttggcaggagtcaaagtggaagataatgcgtttccagcgaagatatttatgctctctttctctctctatccaccatcatcattattcacccatcatcccggtttgctgcatcccttctcttctctctctctctctctggatatatatatacacacatatacatacacaaattgtggcgtcttaatcaaccagcttcgccccttgtttgggatttttctgctcggacttgacttcgatcgagaatctcgactgatctgccctttctcttcggagtgattttggaaagccagatctgtttggtttttgtggaagtcaatatgtcttttattgggacacaacagaaatgcaaggcctgtgagaagactgtttatcccgttgagctttttgtctgctgatggagttagttatcacaaatcctgcttcaaatgctcccattgcaaaggaaccctcaagctgagcaactactcatcaatggagggtgtgctctactgcaagcctcactatgaacagctcttcaaggagactggaagtttcaccaagaactttcaatcccctgcaaagtcagctgagaagttaactccggagctgacaagatcaccgagcaaagctgctgggatgttttccgggacacaagataaatgcgctacttgtggtaaaacagcgtacccacttgagaaggtgactgttgaaagccaaagctatcacaagtcttgtttcaggtgttcccatggaggatgctctctaaatccatcaaactacgcagccctcgacggcattttgtactgcaagcctcatttttctcagctcttcaaagaaaaagggagctacaaccatttaatcaagtcggcatcaatgaaacgcccgactgctgctgccgtccccgattcgtgaactcaaagtcctctgttattatctaaagaatgacgggtgtgtgtctctctgtgtgttaaatctcaattgtatttgatcttgatgcatttaaactcctagtaattgtctttttctttttcccactccctccttcaaaaatggagtgttgttctgctggtggtgttggtgtcaatttatgggatgatgtccaaatttcccaaacagaggttttaaggcaatctttgaatgtcgtacgcattttgcctttcattttggtatttaatattattga

SEQ ID NO: 313 - DNA, 1434 bp, Momordica
gatggtggagctccagtactgaaaaaggtggagaagaaagaaagtcgcaccgggaccgggaccgcgacggagtaaagttgaagcaagcaatgtgtgtctttccggcaaagatatttttctcggatccctttttcactttatcttttctttttctttcccttttttctataaagaaaatcgacgctgtgatgtgaataataatagatcataaattatttgtttctgcctttcgctatctttcctttcattatcttcttcttctctgctccacttgccagaacgaagaacaatcgctgcttttggttattgcctcgatttttagtaggaaaagggtgtttgtttgaccaaagtagcttggtgggtttgaattggaggtgattttgggttggttgagaatagtcagatctactcttaaggcttagctatgtcgtttattggcacccaacagaagtgcaaagcttgtgagaagactgtgtaccctgtagatcagttatctgctgatggagttgctttccacaagtcatgttttaaatgtagccattgcaaagggactctgaagctcagtaattattcttcaatggaaggtgttctgtactgcaagcctcactttgagcagctcttcaaggaaactggcaacttcagcaagaactttctatctcctgcaaaatcgacagataaaccaactccagagctgactaggtcaccaagtaaagctgctagcatgttctctgggactcaggaaaaatgtgctacatgtggaaaaactgcatatccactggagaaggtgacagtcgagagtcaggcctatcacaagtcgtgttttaaatgctcgcacggcggctgttctttatctccatcaaactatgctgcacttgatggaattttgtactgcaaacaccacttttcgcaacttttcaaggaaaaaggaagctacaaccacttgatcaagtctgcatccatgaagcgtcaagcagcaacctcagttcccgatgctgaaaatgtcgagttatgaacttttaatttgaggtttgattccattgttccactgccttttgcccctccttccccagtgtgttctactttgatcctcgcagtctcatgatgggaacgaaagagagcttggacgagcttcctgcatcatgctgagcaaattgtttgtttctttgttggttcatagaacttcaaacagaccatttgaaaatgggcaatttgtttgcctaaagtttaagaaaacattttgaaacttttggttttggcttatcacaaagatatggagtcattctgttttctgttaagttctcagcttctatgtccacaagtggtttagaaaaagggcatcattggaaatgacatggatcatagggtcatagctatcttagatgttttttgggtgtgaaaatattggaagagaacaatggtaaaaggcaatttttt

SEQ ID NO: 314 - DNA, 1182 bp, Papaya
ctccatcaccctcatcgtttatctactttgctgcctcgactctctgcaaatatcccccaatttccgcttctctttctccgcataaaccttaataggaacttgggtttttcgaatttcgacttccttactttctatttctgctttgtgtttacatttccttatttgggtttagatcgatagacttcaagcagctaacaacaagctcgcagatccatcattttcttctgggtcttctcaagatttctatattggagacaactagtttgattggtggagtgatctggaagaggatagaaagaagagtcagatctaagaaaaaggaagcaatttaaagcaatgtcttttattggtacccagcagaaatgcaaggcctgtgagaagacggtctatcccgtggagctcctctctgcagatggggttccttatcataagtcttgcttcaagtgcacgcactgcaaaggcactctaaagcttggaaactattcttccatggaaggcatattgtactgtaaacctcattttgagcagctgttcaaggagacgggtagtttcaacaagaactttcaatcacctgtcaagtcagctgagaagttgactccagagctgacgaggtcacctagcaaagcggccagcatgttttcggggacacaggaaaaatgtgctacttgtggtaaaactgcctatccgttggagaaggtaactgtggagggtcagtcctaccacaagtcgtgcttcaagtgctctcatggcggctgccccatttcaccttcaaattatgcagccttggagggcattttgtactgcaaacaccatttctcgcagctttttaaggagaagggaagctacaatcatctgattaagtctgcatcgctgaaacgtgcaacagcctctgttccagatgcctgaaacaactttaaccgatgtatatttttcatgtatttggttggattttatactgctttccctgtgtgcctctttctttttaccttttggatccctctgatttttgttgtggggagcaaaaacttggcttctcttctcttttgttgtttttgtctcactgatcttttgggatattggttgtgtttgaatgatgtatgggactgtattgcatgcattcccagatctgtaaaatgactcttgcaggactttgtctgcgtaaatgaattaatgcttttcatc

SEQ ID NO: 315 - DNA, 836 bp, Senecio
ggcttttccccaaaatattacttcgtatataaatataaatattcacccatttcccaaatatccatttctttgcgctgcatccaaacattcctcacgatttgaccacaactttgacttcgatcatcaaattcaactcagaattcccccaaatctctgaaatcatcaagatcgtgtatgtaaagttggaatctttaggattggttgttaaacaggggttaaaaaagatcagatctaaaggggaaaagggtaaaaatgtcttttactggaacacagcagaaatgcaaggcttgtgggaagactgtttacccagttgaacttttgtctgctgatggtgttgattatcacaaatcttgcttcaaatgtactcattgcaaaggcactcttaagctgagcaattactcttcaatggaaggtgtgctctactgcaagcctcactttgagcagctcttcaaagaaagtggcaacttcaacaaaaacttcacatcacctgcaaaggatgctgacaagttatctccaatgctgacaaagtcacctagcaaagctgctggtatgttctcgggtacccaagacaagtgtgctacatgtggcaaaactgcttatcctctggagaaggtaaccgtggaaaaccaagcataccacaagtcgtgtttcaagtgctcccatggtggctgttctttatctccatcaaactacgcagctttggagggaattttgtactgtaagcatcatttctcgcaactattcaaggaaaagggcagctacaatcatttgattaaatctgcatccatcaagcgcaatgcagcagcaacagcagcagcagccgcagccgctgccga

SEQ ID NO: 316 - DNA, 817 bp, Flaveria
tataaatataaaaataaaatatctccaaaaccccaattctttacaacattccccaaaatttgacctctgtgttctcccatctctgcaaatcagaacaatttttgactttgatccacacattcaactcaaatttcaaccaaagactgtgaatttatcgagggaggtaaaaaagagaagatcaagatcagatccaaaggttaaaaggggtaattatgaattttactggaacacagcaaaaatgcaaggcttgtgggaagacagtttatcctgtggagcttttgtctgctgatggtgttgattatcacaagtcttgcttcaagtgtagccattgcaaaggcacccttaagctgagcaactactcatcaatggaaggcgtgctctactgcaagcctcactttgagcaactcttcaaggagagtggcaatttcaacaaaaacttcacatcacctgcaaaggctgccgaaaagttatctccaatgctgacaaagtcacctagcaaagctgctggcatgttctctggtacccaagagaagtgtgctacttgtggcaaaacagcttatcctctggagaaggtgacagtggagaaccaagcataccacaagtcatgtttcaagtgctcccacggagggtgttctttatctccatcaaactatgcagcattggagggaatcttgtactgcaagcatcatttctcacagcttttcaaggagaagggcagctacaatcatctcattaagtctgcttccattaaacgcactgcagcatcgacaacagctgctgcagcagcagcagctgctgcttctattccagaatgatg

SEQ ID NO: 317 - DNA, 816 bp, Centaurea
aaggtggaataaaaagatattccatttcatcttctctttctctttctctttctattcactccatcatcttcctttgcaaaaccccatttctttcccttcaaaacttccacattttcatctctattcttcaacaaccctcggcttttatcacaaaatctctgaatctatcaaggggatatcaagatcaaatccaaagggggacaaggttaattatgtcttttattggaacacaacagaaatgcaaagcttgtggaaagacagtttatccagtggagcttttgtctgctgatggtgttgattatcacaagtcatgcttcaagtgtacccattgcaaaggaacccttaagcttagcaactactcgtcaatggaaggagtactatactgtaagcctcacttcgagcagctcttcaaggagagcggaaatttcaacaagaacttccaatcacctgcaaagtctgctgagaaattaacaccacagctgacaaagtcacaaagcaaggctgctgggatgttttctggcacccaagacaaatgtgctacttgtggcaaaacagcttatcctcttgagaaggtgacagtggagaacgaggcatatcacaagtcatgttttaagtgttcccatggtggatgctcgttatcgccatcaaactacgcagcccttgaaggcattttatactgcaagcatcatttctcacagctatttaaggagaagggtagttacaatcatctcgtcctgtcggcaacaatcaaacgaactgccgctgcagaagccgctgccgctagcgcagcagccacagttcctgaagtttgaaact

SEQ ID NO: 318 - DNA, 826 bp, Safflower
ggggctgattgatatatataataaatatcacgcattccccccagaaaccccatttctttacgctgcgtctaaacattccctactatttgacctctgtacccttctgcaaatcagaacaactttgacttcgatcaacaaatccaactcaaatttgaaccaaaattgtctgaattcatccaggtgttgattgagattgaatctggattaaaaaagggtggtgtaaagatttgaagatcggatccagagggggaaagggtaattatgtcttttactggaacacagcagaaatgcaaggcttgtaggaagactgtttacccagtggagcttttgtctgctgatggtattgattaccataaatcttgcttcaagtgtagccattgcaaaggtacccttaagctgagtaattactcgtcaatggaaggtgtgctctactgcaagcctcacttcgagcagctcttcaaggagagtggaaatttcaacaaaaacttccaatcacctgcaaaggcagcagataagccatctccaatgctgacaaagtcacctagcaaagctgctggcatgttctccgggacccaagagaaatgtgcgacttgtggcaaaacagcttatcctctagagaaggtaacagtggagaaccaagcataccataaatcatgtttcaagtgctcccatggaggctgctcgttatctccatcaaactatgcagcgttggagggaattttgtactgcaagcatcatttctcacagctattcaaggagaagggcagctacaatcatctcatcaagtctgcatccatcaagcgctctgcagcagctgcaacagcag

SEQ ID NO: 319 - DNA, 1639 bp, Melon
cagaatgccgatggtggagctccagtactgaaaaaagttgaagtagaaagtcacacccggagggagtaaagtttaagcaagcaatgtgtgtttttccggcaaagatatttcctcagatcccttttcactttatctcttttttcctctataaagaaaatcgacgctgtgaataatctatcataaattatttgtttctgcctttcgctttatctttcatttctttatctttttcttccctgctccacttgctataaccaaatacattccctgcattatgttactttcatgatttgagaggtacccttcttccatttcgattgcatttcagctctaatcaggatcttgttccttcagcattttgatctgggtttgatcctcttagctcatcggctttattttcagagaagggagtttgtttgatcgggatagcttggtgggctttgaattggaggagattctggttgattgggaatagttagatctactctaaggatttttagcgatgtcgtttattggcacccaacagaagtgcaaagcttgtgacaaaactgtgtaccctgtagatcagttatctgctgatggagtttctttccacaagtcatgtttcaaatgtagccattgcaaaggaactcttaagctgagtaattattcttcaatggatggtgttttgtactgtaagcctcattttgagcagctcttcaaggaaactggcaacttcagcaagaactttctatctcctgcaaagtcctctgagaagccaactccggagctgactaggtcgccaagcagagctgccagcatgttttctgggacacaagaaaagtgtgctacatgtgggaaaactgcttatccactggaaaaggttacagttgagagtcaagcctatcacaagtcgtgttttaaatgctcacatggtggctgttctttatctccatcaaactatgctgcacttgaaggaattttgtactgcaaacaccacttttcacagcttttcaaggaaagggaagctacaaccatctgataaaatctgcatcaatgaagcgtcaagcagcaacctccgattcggacccttcaaaagttgagtcataaacttccaatttgtggttttgttgagtccattttccctctgctttcctcctaccccagtgtgttctactttgatcctcacgctgttttgattggaacaaaaaaagaaacttgcacgagtctccagctcgtcatgttgagcctaattgtttgtttgtttgtcgcatggaacttcaaacaaaccgtttgacagtgggcaatgatttgcctaaactttatgaaaacattttgcaacatttagttttgtgttactagaagatagatatggagttattatgttccttgctgaaatcttctctgttttcacgttgacaagttttcgagtggtttggaaaacatcactctctcatcttgatatcagtttggaactgacctaaatcattgctatcttttagaagttttctttggttgtcaaatgcaatattggaggaccttgcatgtctagctgctcctgaagaatggttaaatccgctactttttcttcgacgatcaatctacacaccatggagtagttgggaatcaaaccgttttgcaaatagcgaacaataaattc

SEQ ID NO: 320 - DNA, 757 bp, Avocado
gagcgattttcagcggagagaagttcgtaattagaaaaatctgcgttgttgaaggtgcggatttcggattccgttgaggattttgcgtttgatccggtcttggtgttggttgtagaccgtaggatcgagatcgacaactgatggctttcagcgggacgcagcagaagtgtaaggtttgcgataagactgtatatgtagtcgatcagctgatggccgatggagctgcttaccataagtcttgcttcagatgcaatcactgcaaaggaaccctgaaacttagcaattattcttcactagaaggtgtactgtactgcaagcctcattttgagcagctttccaagaaaacaggcagtttcaacaagagctttcagtcacctgcaaagtcggctgagaaattaactccagaactgactaggtcacctagcaaagctgcgagcatgttctctgggacgcaagagaaatgtgccacttgtggaaaaacagcatatccattggagagggtaactgttgagagccaagcttatcataaatcttgtttcaaatgctctcatgggggctgcccaattactccgtcaaattatgctgccctcgaaggcattttatattgcaaacaccacttctcgcagcttttcaaggagaaagggagctacaaccatctcatcaagtgtgcttcaatcaagcgtacaggtgcaactgcaacacctgttcctgaactctgacctcattctctccggtttatggtactatctcgagtgtg

SEQ ID NO: 321 - DNA, 1192 bp, Clementine
gcatttttgtgcaaatgcaataatatctgtcacattctctctcttcttcatcatcaccatcctctctcgccctgcttagaaaaagctcctccaatcccacgcgccaatgttcattcccccaaccatcgctttctctttctctttctcctctccttaaaacatctctctaatatatatagtctctctaactcaactccccacttgggttttgtccttttccttaaaatctcagctcaatcaacttaaagatccattttttttttcctttccaaagatctaaaagcaatgtcttttattggtacccaacagaaatgcaaggtctgtgagaagacagtttatccagttgagcaattatctgctgatggggttgtttatcacaagtcttgcttcaagtgctctcactgcaaaggcacactcaagctgagcaattactcatccatggaaggtgttctttactgtaagcctcactttgagcagcttttcaaggagtcgggtaacttcaacaagaatttccagtcacctgcaaagtcagctgagaagttaactcctgagctgacaaggtcgcctagcaaagctgccagcatgttctctgggacccaagaaaaatgtgcttcttgcagtaaaacagtgtatccgttggagaaggtagcagtggaaaaccaggcctatcacaagacatgtttcaagtgctcgcatggtggttgttccattagcccatcaaattatgcggccctggaaggcatcttgtattgcaaacatcatttctcccaattgttcaaggaaaaaggaagctacaaccaccttatcaaatccgcttcaatgaagcgtgcagcagcctctgttccagaagcttgaacatgttattcttccttctatttaaatcttatttggtgtgggttttctccggcttgtgggtgtgctttctatttggatccctcttgttgttttttaggggaactaccaaaccttcagttccctctgcttctttggatcatcattgttgggacaaatttcatttgattagacatactgatttatgggatgcatagtcccgtcgtcgtaaattgaccattttctggcaatgatcttttaaaaagagattagtcgttgtttgatgcttcttgttctttgggcttgttcatgaatcatgatgaagatcgcgtttcttctcatcaatttcaaatttcacctg

SEQ ID NO: 322 - DNA, 930 bp, Euonymus
gtaacatacatatccacttcgctgcctctggtcgctgcaaaagaggcgcctactccgctttttactttccataagtgataatcgagagtttgagctcgaccgagctccgctccatcagatccaccattactggttttgacaagatagagattagccagatctaaggagatatagcagctatgtcttttattggtacccaagagaaatgcaaggcatgtcaaaaaactgtttatcctgtcgaacttctatccgctgacggggttaattaccacaagtcttgcttcaagtgtactcactgcaaagggacccttaagctcagcaattattcctcaatggaaggtgttctgtactgtaagcctcactttgagcagcttttcaaagaaacgggtaatttcaacaagaactttcagtcacctgcaaagtcagctgagaagttaactcctgagctgacaaggtcacctagcaaggctgccagcatgttttctgggacacaagagaaatgtgccacctgcaataaaaccgcttatccactggagaaggtaacagtggagggccagtcctatcataaatcttgtttcaagtgttctcatggtggctgtgctatatctccatcgaattatgcagctctcgagggcattttgtattgtaagcaccatttctctcagcttttcaaagagaaggggagttacaaccaccttattaagtctgcatcaatcaaacgtgcagcagcttctgttccagaagcttgagttcgagttccttacatactatctattccagtgtgttttttccaaaccaaagaggaactagcaagaacttggttccctctctcttctgttttatgattttccgtgttttggacattgttgtggttggttggttgattgattgatttgtactccttcatctgtaaactgacttttggaggga

SEQ ID NO: 323 - DNA, 961 bp, Nasturtium
atcattcaccatatatcctcgctgcaccaacccgctgcataaagtccccaccataaaaattctgtcattttagcttacaatcaacgattccattttagtatttttgctttagatcttgtgatttcgtttttcgtttttttgagttcagatcaagaagtttcagctccatagatccactctggtctgattctgttaaagttgattgggggttttgtgggggtattctttacgaagtcagatctagaaaaggaagcgatatatagttcgaagctatgtctttccttggtactcagcagaaatgcaaggcatgtgtgaagacagtgtaccctgtggagctattatccgctgatggggtttcttaccacaaatcttgcttcaaatgcactcactgcaaaggcactcttaagctgagcaattattcctcgatggaaggtgtattgtactgtaaacctcactttgagcagctatttaaggagtcgggtagtttcaccaagaattttcagtctcctgcaaagtcagctgacaagttaactccagagctgacaaggtcacctagcaaagctgctggcatgttttcggggacgcaagaaaaatgtgctacttgtggtaaaactgcatatccactggagaaggtaactgtggagagtcagtcgtaccacaagtcatgcttcaagtgctctcatggtggttgtgcactttcaccatcaaattatgcagccctggagggaattttatattgcaagcatcacttctctcagctttttaaagagaagggaagctacaaccatcttattaagtgtgcatcaattaagcgtgctgctgcctctgttccagaagcttgaaacaacttcttactgtcaattcattctctttatcgtgtgtgtgtttgtcaatgtgctttccatttgcgccccttgaaacattgctgtgggtgcttaacttggacatcataccccctgtt

SEQ ID NO: 324 - DNA, 1024 bp, Orange
cccaaagggctgttggtagctcatttcagtgcaaaatctagtttttgtaagatccagatgatgaatcagttggttggatgactaaaagcccgttctttttgtacagatctaaaagcaatgtcttttattggtacccaacagaaatgcaaggtctgtgagaagacagtttatccagttgagcaattatctgctgatggggttgtttatcacaagtcttgcttcaagtgctctcactgcaaaggcacactcaagctgagcaattactcatccatggaaggtgttctttactgtaagcctcactttgagcagcttttcaaggagtcgggtaacttcaacaagaatttccagtcacctgcaaagtcagctgagaagttaactcctgagctgacaaggtcgcctagcaaagctgccagcatgttctctgggacccaagaaaaatgtgcttcttgcagtaaaacagtgtatccgttggagaaggtagcagtggaaaaccaggcctatcacaagacatgtttcaagtgctcgcatggtggttgttccattagcccatcaaattatgcagccctggaaggcatcttgtattgcaaacatcatttctcccaattgttcaaggaaaaaggaagctacaaccaccttatcaaatccgcttcaatgaagcgtgcagcagcctctgttccagaagcttgaacatgttattcttccttctatttaaatcttatttggtgtgggttttctccgacttgtgggtgtgctttctatttggatccctcttgttgttttttaggggaactaccaaaccttcagttccctctgcttctttggatcatcattgttgggacaaatttcatttgattagagatactgatttatgggatgcatagtcccgtggtcgtaaattgaccattttctggcaatgatcttttaaaaagagattagtcgtcgtttgatgcttcttgttctttgggcttgttcatgaatcatgatgaagatcgcgtttcttctcatcaatttcaaatttcacctg

SEQ ID NO: 325 - DNA, 1078 bp, Poplar
tcgctgcaaaaagcgcccaatccccgctcccttcgctagcccttttatcctttaaaacacccctttcaccctttcaactctttcgctttcttttcatctctcgattcactacctttgattcccagatcgaaatatcccatcttttccgattctaatctcaattcggttatccaaaggagttaacaggacagtcatcagatctagagggtatagtttatatagctagaaacgatgtcgtttactggtacccaacagaaatgcaaggcttgtgagaagactgtgtatcctatggaacttctatcagcagatggggttgcttaccataaaacttgcttcaagtgttttcactgcaaaggcacgttaaagctaagcaattattcttcgatggagggtgtattgtactgtaagcctcactttgagcagctgttcaaggagaccggtaacttcaacaagaactttcagtcacctgcaaagtcagctgagaagttaaatcctgaactgacaaggtcacctagcaaagctgctagcatgttttcagggacacaagaaaagtgcgctacttgcggtaaaactgcttatccgctcgagaaggtaacagttgaaagccaagcctatcacaaatcatgtttcaagtgctcgcacggtggctgtgctataacaccatcaaattatgcagcacttgagggcgtattgtattgcaagcatcacttctcccaacttttcaaggaaaagggcagctacaaccacctcatcaagtccgcaacaatgaagcgtgcagcggcttctgtgccagaggcttaaatatctccatttgatattttatttgtgtggctttatctacttttcattgtgttttccttccatgccctccgatttccattggaaggagtaggcaaaacttggttctgccttgttttttttctctctttctgcccagctatactgggcatgtttgttgtgtttgattgatagatgggtttcaaattctcacaaatgtaaaattacttgcggaggaatttcaattgcaaatattggattctactagtgattcttacttttgtatcttgttgttactgca

SEQ ID NO: 326 - DNA, 808 bp, Flaveria
ctccaaaacctcatttctttacaacattccccaaaatttgacctctgtgttcttcatctctgcaaatcagaacaattttgactttgatccacaaattcaactgaaatttcaacccaagattgtaaatttatcgagggtaaaaaagagcagatcaagatcagatccaaagggtaaaaggggtcattatgaattttactggaacacagcaaaaatgcaaggcttgtgggaagacagtttatcctgtggagcttttatctgctgatggtgttgattatcacaaatcttgcttcaagtgtagccattgcaaaggcacccttaagctgagcaactactcatcaatggaaggcgtgctatactgcaagcctcactttgagcaactcttcaaggagagtggcaatttcaacaaaaacttcacatcacctgcaaaggctgctgagaagttatctccaatgctgacaaagtcacctagcaaagctgctggcatgttctctggtacccaagagaaatgtgctacttgtggcaaaacagcttatcctctggagaaggtgacagtggagaaccaagcgtaccacaagtcatgtttcaagtgctcccacggagggtgttctttatctccatcaaactatgcagctttggagggaattttgtactgcaagcatcatttctctcagctattcaaggagaagggcagctacaatcatctcatcaagtctgcatccatcaaacgcactgcagcaacaacaactgcagctgcagcggcagcggcagcggccgcttcgattccagaatgataattatcatgtgaagc

SEQ ID NO: 327 - DNA, 776 bp, Cirsium
aaaccaccatcaaaactcgtttctttccctacattttcccctctgattccttcatctcttcccaaacagaccaaaaactcttccattttcagacaaagtgtctgaatctatcaagggatatcaagatcaaacccaaagggggaaaagggtaattatgtcttttattgggacacaacagaaatgcaaagcttgtggaaagactgtttatccagtggagcttttgtctgctgatggtgttgattatcacaagtcatgcttcaagtgtagccattgcaaaggaacccttaagctgagcaactactcgtcaatggaaggcgtgttatactgtaagcctcacttcgagcaactctttaaggagagcggaaatttcaacaaaaacttccaatcacctgcaaagtctgctgagaaattaacgccacagctgacaaagtcacaaagcaaagctgctggtatgttttctggcacccaagacaaatgtgctacttgtggcaaaacagcttatcctcttgagaaggtgacggtggagaatgaagcataccacaagtcatgttttaagtgctcacatggaggatgctcgctatcgccatcaaactatgcagcgcttgaaggcattttatactgcaagcatcatttctcacagctatttaaggaaaagggtagttacaatcatctcatcaagtctgcaaccattaaacgctctgccgccatagaagccgctgctgctgccgccgcggctgaaaccactgttcctgaagtttgaaacttgattagaatat

SEQ ID NO: 328 - DNA, 914 bp, Arabidopsis lyrata
tcgtgctccataatcattacttttcatcttcttcttcatcttcacgcagcgacttctttcagctccaatttcaacctgcatttctctcttctcaattttggttttcctttttgatttctcatttttcgatcgacgaagagagaaagaggttttgagctgagagatctttggaggtagaagatctccaaaacgatgtcgtttacaggaactcagcagaaatgcagggcgtgcgagaagacagtgtaccctgtggagcttctctcagctgatggaatctcttatcacaagtcttgcttcaaatgctctcactgcaaaagcagacttcaactgagcaattattcatcaatggaaggagtggtgtattgtaggcctcattttgagcagctcttcaaggagtctggtagtttcagcaagaactttcagtcacctgcaaaaccattgactgataagccaacccctgagctgacaaggacacctagtcgacttgctggtatgttctctggaacgcaagacaaatgcgctacttgcagtaaaaccgtgtatcctattgaaaaggtaactgtggaaagccagtgttaccataaatcttgcttcaagtgttctcatggaggctgtccgatatctccatcaaactatgcagctcttgagggaattttgtactgcaagcaccatttcgctcaacttttcaaggaaaaaggaagttacaatcacctcatcaaatctgcttccatcaaacgcgctactgctgctgctaccgcagccgctgcagctgtagcagccgttcccgaatcttgatttgaaaatctgtttgtctctgtgtctgtgatgtgttgtttacctgtattcgcttcttcatgttctttgtcttcttccataggcataaaattctccgagttttctttgagtttcttgtt

SEQ ID NO: 329 - DNA, 1034 bp, Arabidopsis
agataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgagtttcttgtttgtgatactactacatctataataaccgaggacttttggcttt

SEQ ID NO: 330 - DNA, 768 bp, Flaveria
gacctctgtgttcttcatctctgcaaatcagaacaattctgacttcgatccacaaattcaactcaaatttcaaccaaagattgtaactttatcaagggaggtaaaaaagagaagatcaagatcagatccaaagtgtaaaaggggtaaatatgaattttactggaacacagcaaaaatagcaaggcttgtgggaagacagtttaccctgtggagcttttgtctgctgatggtgttgattatcacaaatcttgcttcaagtgtagccattgcaaaggcacccttaagctgagcaactactcatcaatggaaggcgtgctctactgcaagcctcactttgagcaactcttcaaggagagtggcaatttcaacaaaaacttcacatcacctgcaaaggctgctgagaagttatctccaatgctgacaaagtcacctagcaaagctgctggcatgttctctggtactcaagagaagtgtgctacttgtggcaaaacagcttatcctctggagaaggtgacagtggagaaccaagcgtaccacaagtcatgtttcaagtgctcccacggagggtgttctttatctccatcaaactatgcggctttggagggaatcttgtactgcaagcatcatttctctcagctattcaaggagaagggcagctacaatcatctcatcaagtctgcatccatcaaacgcactgcagcaacaacaacagcagctgtagcagcggcagccgcttctattccagaatgataatcatcgtatgaagct

SEQ ID NO: 331 - DNA, 898 bp, Arabidopsis lyrata
tttcgtttgaggatcagatcttgagaggagtcagctcaaggagagggtgagaaaaagaagaagaaggtgagaaaagtgaaggcaaggcttcgaggatgtcttttacaggaactcaacagaaatgcaaggcttgtgagaagactgtttatgctgttgagcttctctcagctgatggtgttggctatcacaagtcttgcttcaaatgcactcactgcaaaagcaggcttcagctgagcagttactcatcaatggaaggtgtgttgtactgtaagcctcattttgagcagctcttcaaggagagtggtagtttcaacaagaactttcagtcacctgcaaaaccggctgacaaatcaactcctgagctgacaaggacgcctagccgagttgccagcaggttctctggtacacaagagaaatgcgccacttgcagtaaaactgtgtatcctattgaaaaggtaacagtggagagccagacatatcacaagtcttgcttcaagtgctcacacggaggctgcccaatttcgccttccaactacgcagctcttgaaggaatcctgtactgcaagcaccatttcgctcagctcttcaaggaaaagggaagttacaaccacttaatcaaatcggcttccatcaaacgctctgcagccgctgcagtcgctgccggtgtaccagcagcctcgggtcctgaatcttaaaattcaatattctcctctctagtctaaatttgaagttaatgccaaactgattcagtttgctttctgtgtgtgagcgtgtgtgtaatctatcctttcatgttcttatttccattgatatctcctaaaagactttgtttgtgttcgttatttggtatctataaaaaatctgaaacgtttccttataaatcttcaatttcggtttt

SEQ ID NO: 332 - DNA, 1078 bp, Arabidopsis
gaggacaagccaaagtggaaccccacccactgtcttctcaaagattaaaaaaaagaaaaggattttacccaaaatctccgatattcttattcctttgctgtatcatcttcttcttctacttcgtcctcatcatcgtcacatagatcctcctttttcgttaattggggagagatatactttcttttgaggatcagatcgtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttcaaggagaagggaagttacaaccacttaatcaaatccgcttccatcaaacgctctgcagccgcagcagtcgccgccggtgtaccagcagcctccgttcctgaatcttaaaatccaataatttctcctctctagtctaaaatttgaagttaatgccaaactgattcagtttgatttctctttgtgagagcgtgtgtgtaatctatgctttgatgttcttatttccattgatgtctcctaaaattctatgtttgtgtggtgatttggttatctataaaaagtctgaaactttccttataaatcttcaatttcgtttt

SEQ ID NO: 333 - DNA, 775 bp, Euphorbia
cgacagcaacgtgcttctctacaaaaagtgcctaatccgctccattaaattcattttcttcccttcattttcacctctctttccttgactacacactctcagatcgagacttcaactccccattttgttttcatcaatcaagttgcaatgtctttcactggtactcaacaaaaatgcaaggcgtgtgagaagacagtatatcctatggaacttttatctgctgatggaattccttatcataagtcttgcttcaagtgcttccattgcaaaggaactttaaagttgagcagttactcgtcaatggaaggagttctatattgtaagcctcatttcgagcaactattcaaggagagtggtaacttcaataagaattttcaatcacctgcaaaatcagcggagaggctaaatccagagttcacaagatcacctagcaaagctgccggaatgttctccgggacacaagaaaaatgtgctacttgtgggaaaactgcttatccactcgagaaggtaacagtggagagccaggcttatcacaagtcatgtttcaaatgctctcatggaggctgctccttatctccatcaaattatgctgcccttgagggtattttatactgtaagcatcatttttctcaacttttcaaggagaaaggaagctataatcatcttataaagtctgcttccatcaagcgagctgctgcctcagtatcagaatcttgattgcctcgttcgttttttcgtttcttatttatgtgtgtggttttctatttttcgcgtg

SEQ ID NO: 334 - DNA, 858 bp, Euphorbia
tcccatttggtttttatcaatcaagttgaaatgtcttttacgggtactcagcagaaatgcaaggcgtgtgagaagacggtgtatcctatggaacttttatctgctgatggaattccttatcataagtcttgcttcaagtgcttccattgcaaaggaactttgaagctgagcagttattcgtcaatggaaggtgttctatactgtaagcctcacttcgagcaactattcaaggagagtggcaacttcaataagaattttcaatcacctgcaaagtcagcggagaggctaaatcctgaattcacaagatcacctagcaaagctgcaggcatgttttctgggacacaagaaaaatgtgctacttgtgggaaaactgcttatccactcgagaaggtaacagtggagagccaggcctatcacaagtcatgtttcaaatgctcgcacggaggctgctccttatccccatcaaattatgctgcacttgaaggtattttatactgcaagcatcatttttcgcaactattcaaggagaaaggaagctacaatcatctaataaagtctgcatcgatcaagcgagctgcagcctcagtatcagaatcttgattgcctcatcgcttcttcatttcatatttatgtgtgtggttttctattttcggtgtgatttccttcggatctgatttctcccatattaagaggaactggaaaaacgttgatcccgcctccatttttttgtttcaaatcgcctactctgttccgtatattctcgtgtttgattttcaatgggaacatgtaccaaaatttgtaaaatgatctatggaagtcttagattgatgatgctgttactcagtttttttttttgtt

SEQ ID NO: 335 - DNA, 743 bp, Radish
tcatcgctttgatcgtcacactaagatttcasttgtgtttcttctgtggaagatcagatcttggacaatctccagttcaaagcgaggagragaagtaggaagtaaaggcaaaagggggttgaaggatgtcgtcattcacaggaactcaacagaagtgcaaggcttgcgagaagacggtstaccctgtggagcttctctcagctgatggwgttagctaccacaagtcctgcttcaaatgctctcactgcaaatccaggcttcagctgagtagatattcatcgatggaaggtgtgttgtactgtaagcctcattatgagcagctattcaaggagtctggtagcttcaccaagaactttcagtcacctgcaaaaccagctgagaaatcaagtcctgagctgacaaggactcctagccgagttgctggtatgttctctggtacacaagaaaaatgtgccacttgcagtaaaactgtgtatcctatcgaraaggtaacagtggagagccagacatatcacaagtcctgcttcaartgctcacatggaggctgcccaatttcgccttcaaactacgcagctcttgaaggaatcttgtactgcaagcaccatttcgctcagcttttcaaggaaaagggtagctacaaccacttgatcaaatccgcttccatcaaacgctctgcagccgccgcagtagcygctggtwcacagcaacagcggttcctgaatcttaaattcaagaatcatctc

SEQ ID NO: 336 - DNA, 738 bp, Spurge
attcattttcttcccttcattttcacctctctttccttgactacacactctcagatcgagacttcaactccccattttgttttcatcaatcaagttgcaatgtctttcactggtactcaacaaaaatgcaaggcgtgtgagaagacagtatatcctatggaacttttatctgctgatggaattccttatcataagtcttgcttcaagtgcttccattgcaaaggaactttaaagttgagcagttactcgtcaatggaaggagttctatattgtaagcctcatttcgagcaactattcaaggagagtggtaacttcaataagaattttcaatcacctgcaaaatcagcggagaggctaaatccagagttcacaagatcacctagcaaagctgccggaatgttctccgggacacaagaaaaatgtgctacttgtgggaaaactgcttatccactcgagaaggtaacagtggagagccaggcttatcacaagtcatgtttcaaatgctctcatggaggctgctccttatctccatcaaattatgctgcccttgagggtattttatactgtaagcatcatttttctcaacttttcaaggagaaaggaagctataatcatcttataaagtctgcttccatcaagcgagctgctgcctcagtatcagaatcttgattgcctcgttcgttttttcgtttcttatttatgtgtgtggttttctatttttcgcgtgtgatttccttc

SEQ ID NO: 337 - DNA, 1130 bp, Cassava
caattcctcccacccaaaatacttatacatttctatctcagatcatcatccaccttcgttgcaagaagttttcaatctcctctcctctctatatatatctctgtacttccgtttccgttttcctctcctttgaagactgtttaagccctctacgactctttctttttaatttctttttgggtctctttctattccattgactcccagatcgactgtttcagctcaagttttcttcctcttcttcttccatttgggcgatcttggagaggtaaaagaacagtcagatctaagacgtgtagtgttgttaataagctagtatgtcttttactggtacccagcagaaatgcaaggcctgtgagaagactgtatatcccatggaacttctatccgcagatggtgttccttatcacaagtcttgctttaagtgctttcactgcaaaggcactttaaagttaagcaattattcctcaatggaaggtgtactctactgtaagcctcactttgagcagcttttcaaggagacgggtaatttcaacaagaattttcaatcacctgcaaagtcagctgagaagttgactcctgaactgacaaggtcacctagtaaagctgctagcatgttttctgggacacaagaaaaatgtgcaacttgtggtaaaacagcttatccacttgagaaggtaacagtggagagccaggcctatcacaagtcatgcttcaaatgttctcatggtggctgttccttatccccatcaaattatgcagcccttgagggtgtcttgtattgcaaacatcatttctcccaacttttcaaggagaaaggaagctacaatcatcttatcaagtctgcatcgatgaaacgagctgcagcttctgtgccagaagcctgaataccttgtccaaaatttgatatccatgtgtgtctctttactatttcagtgtgctttcctttcggatccgaattccattctgaggaattggcaaaacttgcctcttttttgtttttttggttcagtttcttgggcatgttcttgtgtttgattgatggataggattctcacaaattgtaaaatgaactctggaggagttttatatgcaaatgtggaagttacaatgctgcttcattttctgtt

SEQ ID NO: 338 - DNA, 946 bp, Cassava
tagcagatacaatgtcttttactggtacccagcagaaatgcacggcttgtgagaagactgtatatcccatggaacttctatcagcagacggcgtttcttatcataaatcttgctttaagtgctttcactgcaaaggcactttaaagctgagcaattattcctcaatggaaggtgtagtttactgtaagcctcacttcgagcagctgttcaaggagacgggtaacttcaacaagaattttcaatcacctgcaaagtcagccgagaagttaactcctgaactgacaaggtcacctagtaaagctgctagcatgttttctgggacacaagaaaaatgtgctacttgtggtaaaaccgcttatccacttgagaaggtaacagtggagagccaggcttatcacaagtcatgtttcaaatgctctcatggtggctgttccataaccccctcaaattatgcagcacttgagggtgttttatactgcaaacaccacttctcccaacttttcaaggagaaaggaagctacaatcatcttatcaagtctgcatcaatgaaacgcgctgcagcttcggttccagaagcctgaagaccttgtccataatctgttatctatgtgtgtggctttactatttttcagtgtgtgctttcattcgaatccgacttccatttctgcctccattttggtttctggttcactttactgggcatattgttgtgtttgattgatgcacattcccataaatgtaaaatgacctctggaggtcttttatctacaattgtgtccaaagttacttcttattttttccaagtttcttctctttttgtctaactcagaatccctttctggatgttagagtgctgcttcattttcctttttcctgaattgttacaagcagcatggccatggatggtgaagtgttcataattttcttatgttttccattttccagg

SEQ ID NO: 339 - DNA, 1458 bp, Castorbean
gtcaaagaaaaagaaacagttgaagattaacctcatatttttatgggtaatgaatcttctgtcctttctaacattaaaaagaaacagcgatgatgaagctgtaaaaactttaaccgaaacaaagaactgacaatgaaggagaaaaaagaaaagaaagaaaagcagccgcgtaatcgagaccgttgaaccagacaaactaattgaaatttttagttgtggagcccaactctcttataattatatctcagccaaagatatttcttctctttgtttctctaatctcaattcaatttctctatctcctatcatcataatcatccacttcttttgtatttgttgtatcccttcactgcaaaaagtgcataattacccgctcctctctctttcctttatggttgtgtttttttgggtccttaaaagacatcacaccataaactctcattgactcttcactctttcactttcatatcattcttttctttttctttttttcttatgttcttttatcattcttctttggctctttagttgtctttcttcttcttttcttttttttcctcttctttgactctcagatcaagagtttcagtttaaagttctcctctagctagctactatgtcttttaccggtacccagcagaaatgcaaggcttgtgagaagactgtgtatccgatggaactgctgtctgcggatggtgttccttaccataagtcatgcttcaagtgctttcactgcaaaggcacattaaagcttagcaattattcctcgatggaaggtgtagtatactgtaagcctcacttcgaacagttgttcaaggagacgggtaatttcaacaagaatttccaatcacctgcaaagtccgcagagaagttaactcctgaactgacaaggtcacctagcaaagcagcaagcatgttctctggcacgcaagaaaagtgtgctacttgtggtaaaactgcttatccactggagaaggtgacagttgaaagccaagcctatcacaagtcctgtttcaaatgctctcatggtggctgttccatttctccatcaaattatgcagcccttgagggtgttttatattgcaagcatcatttttctcaacttttcaaggagaagggaagctacaaccatcttatcaaatccgcatcgatgaaacgtgctgcagcttcagtaccagaagcttgaatgccttgtcctaatttgataatatatgtgtgtggatttactatttacagtgtgtgtttttcttttttacctcggatccgacttccattacgaggaattggcaaaacttagttctgccttgtttttgattctctttgttgggagcatcgttgtgtttgattgatggatgggatgccccattcttgcaattgtaaaatgaactttggaggacttaatatgcaaatttggatgctactagtgcttcatcattttctatttcttttgcttgttac

SEQ ID NO: 340 - DNA, 1054 bp, Cotton
aaaccccataagcccttttcactcctttttatactctcattttacgtttatttcttctttctttcatagatccaggccttcttcttcttcttcttcttcttcttcttctatcaaagttaatataggcaaatataagagaagaaatcgaattaaagtttatctgtggaactagataaagaacagtacgatttgttttgatccaaagcacattcgagccatgtcgtttattggtacccaacagaaatgcaaggcttgtgagaagactgtttatccagttgaacttttgtctgcagatggagttccttaccataaatcttgcttcaagtgcagtcattgcaaagggacactaaagttggctaattactcctcaatggaaggtgttctttactgcaagcctcatttcgagcaactcttcaaggagacgggtaacttcaacaagaatttccaatcgtctgcaaaggcagctgagaagttaactcccgagctgacgagatcaccaagcaaagctgccagcatgttttctgggacagtcgaaaaatgtgctacttgtggcaaaactgcatatccacttgagaaggtaacagtagaaggacagtcttaccacaaatcatgtttcaagtgctctcatggtggctgctctttaagtccatcaaattatgcagcacttgaaggcattttgtactgcaaacatcacttttcccagctcttcaaggagaaaggaagctacaatcatcttatcaaatctgcatcaatcaagcgtaccgctgcatccgttcctgaagcttgaatacctatgtcatgttcttcgtctattcccatgtttgccggtgtgttttcgtattgatttctttgatttatgcccaggaggggaaccgggtagaaagaactcgggtttctctccgtttgtttgaggctttggtatttgattgatctaagtagaagtgaatgttgtaacaggactctctgtgcaagaattttttgcaattcaaatttggctccttccgaattaatatttttataagtaataaaaatgttagatatactgcttggcaat

SEQ ID NO: 341 - DNA, 960 bp, Cotton
atcaaagttaatataggcaaatataagagaagaaatcgaattaaagttgatccgtgaaactagataaagaacagtacgatttgttttgaccaaagcacattcgagccatgtcatttattggtacccaacagaaatgcaaggcttgtgagaagactgtttatccagttgaacttttgtctgcagatggagttccttaccataaatcttgcttcaagtgcagtcattgcaaagggacactaaagttggctaattactcctcaatggaaggtgttctttactgcaagcctcatttcgagcaactcttcaaggagacgggtaacttcaacaagaatttccaatcgtctgcaaaggcagctgagaagttaactcccgagatgacgagatcaccaagcaaagctgccagcatgttttccgggacagtcgaaaaatgtgctacttgtggcaaaactgcatatccacttgagaaggtaactgtagaaggacagtcttaccacaaatcatgtttcaagtgctctcatggtggctgctctttgagtccatcaaattatgcagcacttgaaggcattttgtactgcaaacatcacttttcccagctcttcaaggagaaaggaagctacaatcatcttatcaaatccgcatcaatcaagcgtgccgctgcatccgttcctgaagcttgaatacctatttcatgttcttcgtctattcccatgtttgccggtgtgttttcttattgatttcttggatttatgctcgggaggggaactggaaagaaagaacttgggtttctctccgtttatttgaggccttggtatttgattgatctaagtagaagtgaatgttgtaacaggactctgtgcaagattttttatgcaatccaaatttggctcatttcgaatgaatattttataaataataaaaatgttagatacactacttggcaataaagaaccctgttagcta

SEQ ID NO: 342 - DNA, 1117 bp, Cucumber
aatcaataaaaatctttctttaatttttctctttattattaatcccaaattcgaacataaaactcccactacgctgcgccaaaaagggggtccaatccaatccctttacttgtttttctcttcttccctcgatctttcttcctttctcctctcgaccctttccccaccttcgatttctcccacgaattcgcttctgggttctttgttttggcccttttcgtttacagatccaccgtttttccaagttcttatctcagagaaaggaacttaggtttgagagttggggattgcttgtcatcttgattggttgggtgaaaaagggtcagatctaattccaagggcttagctatgtctttcattggcacacaacaaaagtgcaaggcctgtgagaagactgtctaccctgtagagcagctctctgctgatggagtttcctaccataaatcttgcttcaaatgcagccactgcaaagggaccctaaagctgagcaattattcttcaatggaaggtgttctgtattgtaagcctcattttgagcagctcttcaaagagactggcaatttcaacaaaaatttccaatcacctgccaagtcagctgagaagttaaccccagagctgactaggtcacctagcaaagctgctggcatgttttctggtactcaagacaaatgtgctacttgtggcaaaactgtctatccattagagaaggtaacggttgaaagccaatcctatcacaagtcctgttttaagtgctctcatggagggtgtgctttatccccatcaaactatgcagcattagagggtattctatattgcaaacaccacttctctcagcttttcaaggaaaagggaagctacaaccacctgatcaagtctgcatccatgaagcgctccgctgccccggttcctgaagcttaaagttccaattcttatatcatcatcatcattcacggtttcggacttaactctctattttacatgaatgtgtttaacttaaatttttatggtattgagatgggaaagaagggtaaaggaaaaatatatatgtttaccatcatttcggctcatgtgtttatttgggcaaactgttgaatttgatcgatatttgaggtgcaaa

SEQ ID NO: 343 - DNA, 999 bp, Cucurbita
tccctctccttattcttcacctcttcccttctcccccctcgaacatctctgacgattccgctttgtttggtttacagatccaccattttcccagtctctaatctcagaatttgattcgaggagcgtctacgttcagtccgattgtggtctaacaagacagagaagggaagttagcttggagagttggggattggttgtcatcttggtcggttgggtgaaaaaggctcagatctaactccaagggcttagctatgtctttcattggcacccaacaaaagtgcaaggcctgcgagaagactgtgtaccctgtggagcagctctctgttgatggagtttcctaccacaaatcttgcttcaaatgcacccactgcaaagggactctaaagctgagcaattattcatcaatggaaggtgttctgtactgtaagcctcattttgagcagctcttcaaagagagtggcaacttcaacaagaactttcaatcacctgccaagtcagctgagaagttaactccagagctgacaaggtcacctagcaaagctgctggcatgttttctggtactcaagacaaatgtgctacttgcggtaaaactgtttatccactagagaaggtaacagtggaaagccaatcgtatcacaagtcctgttttaagtgctctcatggagggtgttccatatccccatcaaactatgcagcgctagagggtattctatattgcaaacaccatttctcccagcttttcaaggaaaagggaagctataaccacctcatcaagtctgcatccatgaagcgtcccgctgcctccgttcccgaagcttgaagttcttattatcgcatcgtcattcacggttttggacctaactctctgtttacctgaatgtgtttgactttaaaaacttatgggttttgagatgggaaaaggaaaatatatatgttaaccatcatttcggctcggttcgtgtgtttatttggacaaactgttgaattcgatcgatatt

SEQ ID NO: 344 - DNA, 1314 bp, Gossypium raimondii
taataataaatacataaataaaataataaataaggttatcgtatcaaaaaatggaataaaattcactctctttcgacattctctctcttcctcctccaccatcatcatataatacacgtctacagcatctgttcgctgcaaaaagtacacaatctcccacttcctcttttacactcccttcatttttggtctttgaaaccccataagcccttttcactcctttttatactctcattttacgtttatttcttctttctttcatagatccaggccttcttcttcttcttcttcttcttctatcaaagttaatataggcaaatataagagaagaaatcgaattaaagttgatctgtggaactagataaagaacagtacgatttgttttgatccaaagcacattcgagccatgtcgtttattggtacccaacagaaatgcaaggcttgtgagaagactgtttatccagttgaacttttgtctgcagatggagttccttaccataaatcttgcttcaagtgcagtcattgcaaagggacactaaagttggctaattactcctcaatggaaggtgttctttactgcaagcctcatttcgagcaactcttcaaggagacgggtaacttcaacaagaatttccaatcgtctgcaaaggcagctgagaagttaactcccgagctgacgagatcaccaagcaaagctgccagcatgttttctgggacagtcgaaaaatgtgctacttgtggcaaaactgcatatccacttgagaaggtaacagtagaaggacagtcttaccacaaatcatgtttcaagtgctctcatggtggctgctctttaagtccatcaaattatgcagcacttgaaggcattttgtactgcaaacatcacttttcccagctcttcaaggagaaaggaagctacaatcatcttatcaaatctgcatcaatcaagcgtaccgctgcatccgttcctgaagcttgaatacctatgtcatgttcttcgtctattcccatgtttgccggtgtgttttcgtattgatttctttgatttatgcccaggaggggaaccgggaagaaagaactcgggtttctctccgtttgtttgaggctttggtatttgattgatctaagtagaagtgaatgttgtaacaggactctctgtgcaagattttttatgcaatccaaatttggctcctttcgaattaatatttttataaataataaaaatgttagatatactacttggcaataaagaaccctgttcgctatcatcatgttggaactatgttcacataagttgtaatgtaaagttttgaaaaa

SEQ ID NO: 345 - DNA, 999 bp, Melon
cgataaatctttctttaattttctctctattattaatcccaaattcgaacataaaactcccactacgctgcgccaaaaagggggtccaatacaattcctttacttgtttttctcttctttcctcgatttttcttccttttttctctcgaccctttccccaccttcgatttctctcacgattttgcttctgggttctttgttttggcccttttcgtttacagatccaccgtttttccaagttcttatctcagagaagggaatttaggtttgagagttggggattgcttgtcatcttggttggttgggtgaaaaaggctcagatctaattccaagggcttagctatgtctttcattggcacacaacaaaagtgcaaggcctgtgagaagactgtctaccctgtagagcagctctctgctgatggagtttcctaccataaatcttgcttcaaatgcagccactgcaaagggactctaaagctgagcaattattcttcaatggaaggtgttctttattgtaagcctcatttcgagcagctcttcaaagagactggcaatttcaacaagaattttcaatcacctgccaagtcagctgagaagttaaccccagagctgactaggtcacctagcaaagctgctggcatgttttctggtactcaagacaaatgtgctacttgtggtaaaactgtctatccattagagaaggtaacagttgaaagccaatcctatcacaagtcctgttttaagtgctctcatggagggtgtgctctatccccatcaaactatgcagcactagagggtattctatattgcaaacaccacttctctcagcttttcaaggaaaagggaagctacaaccacctgatcaagtctgcatccatgaagcggtccgctgccccagttcctgaagcttaaagttccaattcttatatcctcattcacggtttcggacttaactctctattttacatgaatgtgtttaacttaaatttttatgatatt

SEQ ID NO: 346 - DNA, 1250 bp, Watermelon
tacattaatcaataaaaatcctttctttaatttttctctttattactatcccaaattcgaacataaaactcccactacgctgcgccaaaagggggtccaatccaatccctcctcttgtttttctcttcttccctcgatttttcttcctttttccccctccacccttttacccatctcgaatttctctgacgatttcgcttttgggttctttgttttgacacttttggtttacagatccaccgtttttctaacctccaatctcagcgaagggaagttagggttgagagttggggattgcttgtcatcttggttggttgggtgaaaaagactcagatctaactccaagggcttagctatgtctttcattggcacacaacaaaagtgcaaggcctgtgagaagactgtctaccctgtggagcagctctctgctgatggagtttcctaccataagtcttgctttaaatgcagccactgcaaagggactctaaagctgagcaattattgttcaatggaaggtgttctttactgtaagcctcatttcgagcagctcttcaaagagaccggcaacttccagaagaacttccaatcacctgccaagtcagctgagaagttaactccagagctgactaggtcacctagcaaagctgctggcatgttttctggtactcaagacaaatgtgctacttgtggtaaaactgtctatccattagagaaggtaacagttgaaagccaatcctaccacaagtcctgttttaagtgctctcatggagggtgtgctatatcaccatcaaattatgcagcattagaaggtattctatattgcaaacaccacttctcccaacttttcaaggaaaagggaagctacaaccacctgatcaagtctgcatccatgaagcgttctgctgcccctgttcccgaagcttaaagttctaattctcgtatcattattcacggtttcggacatgactctctatttacatgaatgtgttttaacttaaaaatttatgttttcgagatggaaaaaagggtaaaggaaaaatatatatgttaccatcatttcggctcgtgtgtttatttgggcaaactgttgaatttgatcgatatttgagatgcaaaccttatttattgtttccaggacttgcatattgcatattttgagcattatgcattgtgttttcgtgcataacaaaaacatttatggagagaatgggaacagaaagctgcagattgaataccaaaaaataaaagat

SEQ ID NO: 347 - DNA, 1365 bp, Cannabis
tattttcattttaaaaggttaaaaacatattctttttaaatttgatcaacgagttttagtccacccagtttcaaagatccaacatttttcacttggttcaaaagggtataaggttgaagaaggaagaaattttgggcagtgtacttggtggtggtgttggggtggggaggagagctcagatctaaaatcataaacagttaattatgtctttccttggaacccaacagaaatgcaaggcttgtgataagacagtttatccagtggagcagctatctgcagatggtgtttcttaccacaagtcatgcttcaagtgcaccggttgcaaagggactttaaagctgagcaactattcctccatggaaggtgttctgtactgcaagcctcattttgagcaactcttcaaggaaactggcaatttcaacaagaactttcagtcacctgcaaagtcagctgagaagttaactccagagctgactagatcacctagcaaagctgccagcatgttctctggaacacaagagaaatgtgccacttgtggtaaaaccgcctatccactggagaaggtgacagtggagagccttagttatcacaaatcttgcttcaagtgctctcatggtggctgtgccctttcaccatcaaactatgcggctttggaaggaattctgtactgcaaacaccatttctctcagctcttcaaggagaagggaaactacaaccatctgatcaagtctgcatcgattaaacgggctgctgctgcagcctccgttccagaagcagaagcagaagcataagctcatgaaggaaaaagaaaaaacgaataataaaagaaaagaaaaaaaagaaacaacaaaagagaacttgtggtgtggttacaatgactttctttctatcgatttgagagtgttttcattttattttattcatctcaacattatgatgctctatttttacatgatggaatgtaggagtggcaaaacttggctcttctctttttgtcatgtatggctaaaggggtctcactagtgttgggctgtggtgtttttttgatgttgttgtatgggaatgggatgttgaaatccaacggttgtaaaatgacaattcaggacctgagatgcaagtcgtgttgcctttttcataaagacatggaaacacccgagtcaagccagtttattcttttatcacttctctcgactcaagacgtgaactccatacacatacatacgtgcatatgtattataatatttctagttcaaacaaaattaatttttttagtcaaccaaataaatgggagatgaggctgtctcatgttttttaataaacaaaatcatatttttcatgaatagatgtgacattttttcttaattt

SEQ ID NO: 348 - DNA, 714 bp, B. juncea
gggggttgaagaaggatgtcttcattcacaggaactcaacagaagtgcaaggcttgcgagaagacggtctaccctgtggagcttctttctgctgatggtgttagctatcacaagtcctgcttcaaatgctctcactgcaaatccaggcttcagctgagtagatattcatcgatggaaggtgtgttgtactgtaagcctcattatgagcagctcttcaaggagtctggtagcttcaacaagaactttcagtcacctgcaaaaccggctgagaaatcaagtcctgagctgacaaggactcctagccgagttgctggcatgttctctggcacacaagagaaatgtgctacttgcagtaaaactgtgtatcctatcgaaaaggtaacagtggagagccagacatatcacaagtcctgcttcaagtgctcacatggaggctgcccaatctcgccttcaaactacgcagctcttgaaggaatcttgtactgcaagcaccatttcgctcagcttttcaaggaaaagggtagctacaaccacttgatcaaatccgcttcaatcaaacgctctgcagccgccgcagtagctgctggtacaccagcaacggctgttcctgaatcttaaattcaagaatcatctcctctccagtctaaattgaagttattgccgaactgattcgttttcttttttcttcgtgtcttcgtgtaatctatccttcaa

SEQ ID NO: 349 - DNA, 817 bp, Radish
aagtaaaggcaaaagggggttgaaggatgtcgtcattcacaggaactcaacagaagtgcaaggcttgcgagaagacggtctaccctgtggagcttctctcagctgatggtgttagctaccacaagtcctgcttcaaatgctctcactgcaaatccaggcttcagctgagtagatattcatcgatggaaggtgtgttgtactgtaagcctcattatgagcagctcttcaaggagtctggtagcttcaccaagaactttcagtcacctgcaaaaccagctgagaaatcaagtcctgagctgacaaggactcctagccgagttgctggtatgttctctggtacacaagaaaaatgtgccacttgcagtaaaactgtgtatcctatcgaaaaggtaacagtggagagccagacgtatcacaagtcctgcttcaaatgctcacatggaggctgcccaatttcgccttcaaactacgcagctcttgaaggaatcttgtactgcaagcaccatttcgctcagcttttcaaggagaagggtagctacaaccacttgatcaaatccgcttccatcaaacgctctgcagccgcggcagtagccgctggtacaccagcaacagcggttcctgaatcttaaattcaagaatcatctcctctctctagtgacctaaactgaagctactgccaaaccgattaagtttgttttctctttgtgtgtgagtgtgtgttctttgkttccattgatgtctcctgaagtctttgtrttgttatctattaaaaaaaagtytgatamattccttttggaaaacatcagtttcagtacga

SEQ ID NO: 350 - DNA, 1313 bp, Sarracenia
ggatccctgtcatcatccactctgctaggacgctgcatacgcttcctgcaagaaaagcttcctttctccattccccatctctataaataaatacacaaacaaacgcatcctgccatcctgtcaccgtaaaagatctccatttccgcttccgtgatagtcttcggatttcattattgactttgatcaacagtcaagtatttctcacaatcccatcgaggtcctacggtagtttgagattaatcgaagcagaaaggcgcggacgattggtggagacatcagatttgcagagataaactcaaaatcatggctttcaccggcacacaacagaagtgcaaggcctgcgaaaagacagtttatccggttgagctgttgtctgctgatggagtttcttaccacaagtcatgctttaggtgtagtcactgcaaagggactctcaagttgagcaattactcctcaatggaaggtgttctgtattgcaagcctcattttgagcagctcttcaaagagacgggtagcttcaacaagaacttccaatcgccagccgcaaaattgcctgagaagtcaactccagtgttgacaaggtcacctagcaaagctgccaccatgttttctgggacacaagaaaaatgtgcgacatgtggtaaaacggcttatccactcgagaaggtaactgtggagagccaggcctatcataagtcatgctttaagtgctctcatggtggctgtgctctatctccatcaaactatgcagccctggagggcattttatattgcaagcaccatttctcccagctttttaaggagaaagggagctataaccatctcatcaagtcggcatcaatgaagcgcccaacagcctctattccagaagcttgaactttatgggtatgtttgatcgatcggattagacgtgaaattggattatatattctatgagattatatttcccttgtttgaattcaacaaatgatgtgagaatcctatatgtattggataattaatccacaaaatgtggaatacgcaatacataactaaatgtgatattaataattcactcattacaagtctcatgagattactcatcaagtgagattatatatcctcttattattaatccaatcaatcaaacatagcctatatcttttgttatcgtccattttgcttgggtttgcttctgttccaagtgtgaacctttgtaatttcactatggttttcatgttgaaaaaaccgactgccgaggtcttttcacttattgttttcttccgtgttcagtcggaatcttgttgttgtttgatttatatatggggttcgca

SEQ ID NO: 351 - DNA, 1481 bp, Gossypium raimondii
atgacaccaacgttgtcaaataatcaaagccaccatagttgagtttggttgaaaccaatgacttgttccatccatcaaaccatataatataatattccttatatatatatatatatatattattctcttgtttctttgagttatttcccaataatttctcattatctatttcttctctaattccttagaacacccttttgactcttttacagcttttgaactttctctttaatttgatttcattttttgttcatcttatttcatagatccaatacttacttctttcaacgtattaaagaacaaaatattgaattgaagctctagatctaaagcatatattggagccatgtcttttattggtacccaacaaaaatgcaaggcttgtgaaaagactgtttacccagtggaacttgtatcagtagatggggttcctttccataaatcttgcttcaaatgcagccattgcaaagggacattaaagtggggtaattactcatcaatggaaggtgttctttattgcaagcctcatttcgagcagctattcaaggaggcgggtaactacaacaagaattttcagtcacctgccaagtcagccgagaagttaactcaactgacaagatcgcctagcaaagcggctggcatgttttccgggacacaagacaaatgtgctacctgtgggaaaactgcttatccactcgagaaggtaacagtggaaggtcaatcttaccacaaatcatgtttcaagtgctctcatggtggttgccctataagcccttcaaattatgcagcacttgagggcattttgtattgtaagcatcacttttcccagcttttcaaagagaaaggaagctacaatcatttgatcaagtccgcatcgattaagcgcacagccgcctctgttccagaagcttgatttatagaaatccctttttttcatgtttttctttctgttcttgtgtttgctggattttttttccttatgaatcctttgatttatgtttatgaacaaaaaaggggaagaaaaaacttgaatttcctctatggcttattcacctgcagatatgtaatggcattttattgatggatggatatgcattctccaaattagaatttgtaaaaaaaaacccttgctttgtttgcatggtaccacatgttgatgtactttcgatgtttgccttgctttaaagttcctctcatcttcatttccatgtatatgtatgtatctatgcatgcatgtatgtatgcattctccaaattagaatttgtaaaacatcccttgcttgcttgcttgcatgatacatcgtgttgatgtacttttgatgtttgccttgctttaaagttcctctaatcctcattttcatgtatatgtatggatctatgtatgtatgcatgtgcatgtatcatgcatgcatagatggatgaggatatgcattctccaaactagagtttgtaaaacaacccttgctttgcttgcgtgatac

SEQ ID NO: 352 - DNA, 660 bp, Heritiera
cttcttctgttatcaagttgatattggcatatatagaagaggaattgaattaaagcagatctgtggaattagataaagaacagttcggttggatctaaagcatactcgagccatgtcttttatcggtacccagcagaaatgcaaggcttgtgagaagactgtttatccagtggaacttttgtctgcagatggggttccctaccataagtcttgcttcaagtgcagtcattgcaaagggacgctaaagtttgggtaattactcctccacggaaggtgtcctttattgcaagcctcattttgagcaactattcaaggagacgggtaacttcaacaagaattttcagtcacctgcaaagtcggctgagaagttaactcccgaactgacaagatcacctagcaaggctaccagcatgttttcagggacacaagaaaaatgcgctacttgtggcaaaactgcttatccacttgagaaggtaacagttgaaggacagtcttaccacaagtcatgtttcaagtgctcccatggcggctgccctataagcccatcaaactacgcagcccttgagggcattttgtactgcaaacaccacttctcccagcttttcaaggagaaaggcagctacaatcatcttatcaagtctgcatcgattaagcgcactg

SEQ ID NO: 353 - DNA, 870 bp, Momordica
gaacaattctttgtcccaaattcgaacataaaacttccactaccctgcggcaaaaggggggtccaatccgatcccctttgattttctcctctatatttctcccctctccggccgcccttcttcccccctcgagttttctgaggctaacgcttttggggttcattaatttggctctgttcttcgcagatccaccatttctacagcccctaatctcaggacagagaggggaagttaggcgcgagggttgggtggaaaaggggtcggatctaattccaagggcttagctatgtctttcactggcacactaataaagtgcaaggcctgtgagaagactgtctaccctgtggagcagctctctgccgatggagttatctatcataagtcttgcttcaaatgcacccattgcaaaggaactctaaagctgagcaattattcttcaatggaaggtgttctgtactgcaagcctcatttcgagcagctcttcaaagagacaggaaacttcaacaagaacttccaatcacctgcaaagtcagccgacaagttaaccccagagctgactagatcacctagcaaagctgctggcatgttttctgggactcaagacaaatgtactacttgtggtaaaactgtttatccactggagaaggtaacagttgaaagccaatgctttcacaagtgctgtttcaagtgctctcatggagggtgtgctatatccccatcaaattatgcagctctagagggtattctatattgcaaacaccacttctcccagcttttcaaggaaaagggaagctacaaccacctgatcaagtctgcatccatgaagcgtaccgctgcctccgttcccgaagcttgaagttctaatccttg

SEQ ID NO: 354 - DNA, 974 bp, Petunia
agtcttcactttgatcacatataatctttttgcttcatcccttgtaagatcaattgctagtacaacattcttttgttatctctcaatagttaaatctgagggggaacaaagggaagagctttaaggatcagatcttgataatttgtggtgaagtcatgtcttttacaggaacccaacaaaaatgcaaggcttgtgaaaagacagtttatccagttgaacttttgtcagctgatgggattagctatcacaaatcttgcttcaaatgtacccattgtaaaggaactcttaagttgagcagttactcctcaatggaaggtgttctgtattgcaagccccattttgagcagctctacaaggagtctggcaacttcaacaagaactttcaatcacctgcaaagtctgctgagaagttaactccagagctgacaagatctcccagcaaagctgccagcatgttttctgggactcaggaaaaatgtgccacttgtggtaaaacagcttatccacttgagaaggtgacagtggaaaaccaaagttatcacaagtcgtgtttcaagtgttctcatggtggatgctctctaaatccttcgaattatgctgcactaaatgggattttatactgcaagcctcatttttcacagcttttcaaggagaaaggcagctacaatcatttaatcaagtctgcttcaatgaagcgtccagcagcaactgttccagattcttaaactatatctctgccaatgatttatccacatgggcttggtcttttttattttgttttcatcgtctttctttatgtctccggctgattaagcatcttggtttactgtgtgatctaatttccaccattgtgaaacaattatcctattgttcctcttaacttttggatgttaaacaatcctgctgttttctcatgacatttggcagaagtaagttgtgcagttcatatgagtgttggttcctaataaaaaaaa

SEQ ID NO: 355 - DNA, 1138 bp, Cichorium
tcaagggactggtttcgtagatcagtcaagactctttcagctatcatcatcatcatcatcgcacttcgctacatccactacgctgcaaaaagcacatcttttcccagcattgattgattaactgatatataaatatcacacagttccccaaaaaaacccatttctttgcgctgcgtctaaccttctcagacattccccacaatttgacctctgcaaaccaaaagcactttgacttcgatcgacaaatccaactcaaatttcaacagaagtctctgaatttatcaagggtagcagaggaaaagatcaagatcagatccgtaggggaaaagggcaattatgtcttttactggaacacagcaaaaatgcaaggcttgtgggaagactgtttacccagtggagcttttgtctgctgatggtattgattatcacaaatcttgcttcaagtgtagccattgcaaaggtacccttaagctgagcaattactcatcaatggaaggcgtgctctactgcaagcctcactttgagcagctcttcaaggagagtggaaattttaacaaaaacttccaatcacctgcaaagtcagccgaaaagttatctccaatgctgacgaaatcaccaagcaaagctgctggcatgttctcgggtacccaagagaaatgtgctacttgtggcaaaacggcttatcctctcgaaaaggtaacagtggagaatcaagcctaccacaagtcatgtttcaagtgctctcatggaggctgttctttatcgccatcaaactacgcagcattggagggaatcttgtactgcaagcatcatttctcacagctgttcaaggagaagggaagttacaatcatctcattaagtctgcatccattaagagatctacccccgagtctattccggaagtttgagacacctcccgctaattcatatccatcatcttaccaacaaagttttcggtttgttttggttgtgtttgttttttttggttatgatttgatgattaagctttcgacttatcgacttccttttgtttgattggttggttccttgggtgcccatatttatctaagcatatttcctctcttcttgtaattgagtttaaaccctttcagtcactcaaagccttactttcaaaaa

SEQ ID NO: 356 - DNA, 957 bp, Cleome gynandra
gggggggatttttttagcatctctcttcgtacgatcctgctgatcatctctcaaagctcctccattggtatcgtatcgaggaaagtcttagctctagcagagggatccgccatttctgaaaatttggaggtagaaattgattgtgtttgtgtgggattttagaagcaaaggcaaaagtgaagaaaagctatgtcttttacgggcactcagcagaaatgcaagacgtgcgagaagactgtgtatcctgtggagcttttatctgctgatggagtagggtatcacaagtcttgcttcaaatgcactcactgcaaaagcaggttgcagctgagcaactattcatccatggaaggtgtattgtattgtaagcctcactttgagcagctgttcaaggagacgggaagtttcaacaagaacttccaatcacctgcaaagccagctgagaagccaactcctgaactgacaaggacacctagtaaggttgccagcatgttctcgggaacacaagacaaatgcgccacttgcagtaaaactgtgtatccgctcgaaaaggtaacagtggagagccagtcataccacaaatcctgcttcaaatgctctcacggagggtgcccgatttccccttcgaattatgcagccctcgagggaatcctgtattgcaagcaccattttgcacagctattcaaggagaaaggaagctacaaccacctgatcaaatctgcatccatcaaacgtacggctgcagccgcaggcgtagcagcaacaacagtccccgaatcttaacttgaatgatcgatctgaaccttttctcgggcatgtttgattgtgtctgcgtgagcattttatccctcctcggagttcttgtttccatagaaatgatgaaccaacccaagaaagtatcgtaatagttgcttgttattgtcttgtgacaactcgagtgcttgttattttctcttgttg

SEQ ID NO: 357 - DNA, 982 bp, Hevea
cagcttaatgcctctttgactctctcactttcattccatttcttcttccttttgggggtctctttctctttctttgactctcagatcgactgtttcagcccaagttttcttcttcttccatttaggtaatcttggagacgtaaaaaccagtcagatctaagacatatacacattctttagcagctacaatgtcctttactggtacccagcagaaatgcaaggcttgtgagaagactgtatatcccatggaacttctatctgcggacggtgttccttatcataagtcttgctttaagtgctttcactgcaaaggcactttaaagctgagcaattattcctcgatggaaggtgtactatactgtaagcctcacttcgagcagctgttcaaggagacgggtaacttcaacaagaattttcaatcacctgcaaagtcggctgagaagttaactcctgaactgacaaggtcacctagtaaagctgctagcatgttttctgggacacaagaaaagtgtgctacttgtggtaaaactgcttatccacttgagaaggtaacagtggagagccaggcctatcacaagtcatgtttcaaatgctctcatggtgggtgttccttatccccatcaaattatgcagcccttgagggtgttttgtattgcaaacatcatttctcccaacttttcaaggagaagggaagctacaatcatcttatcaagtgtgcatcaatgaaacgtgcagcagcttctgttcctgaagcctgaataccttgtcaacaatctaatatctatgtgtgtgtggctttactatttttcggtgtgctttccttcggatccgacttgcattatgaggaattggcaaaactttgttctgcctcttttggcatttggttcaatttattggcatatgtgtgtttgatgatggatgggacacacatcccacatttgtaaatgactgtgaggactttctgcaatgtggaagttaccaa

SEQ ID NO: 358 - DNA, 1270 bp, Poplar
agacaaacaaaaagtgtttgtggagcctgtaagtgcttccagcgaagaagatatttttcatctctctcttactctttctgtcttctaatattttttataacctctgaaattctctctccctctatcatcatcatcatcatccactttgttgcatccgctccgctacaaaaagcgcccgcgcccaatccccgctcccttcactttcctcgaccctttcactttcatttcaattctctccactcacctcccttgaccctcagatcgaacaatcccatcttctcttattctaatcgcaatttgactggcaggtgatctgagacaggtaaacagtacacagtcatcagatctaaagggtataatacatatcgctcgaaacgatgtcgtttactggtacccaacagaaatgcaaggcttgtgagaagactgtgtatcccatggaacttctatcaacagatggggttgcttaccataaatcttgcttcaagtgttttcactgcaaaggcacgttaaagctaagcaattattcatcaatggagggtgtattgtactgtaagcctcactttgaccagctgtttaaggagaccggtaacttcaacaagaactttcagtcgcctgcaaagtcagctgagaagttaactcctgaactgacaaggtcacctagcaaagctgctggtatgttttcagggacacaagagaagtgtgctacttgcggtaaaactgcttatccgcttgagaaggtaacagtggagagccaagcctatcacaagtcatgtttcaagtgctctcacggtggctgtgctataacaccatcaaactatgcagcgcttgagggtgtattatattgcaaacatcacttttcccaacttttcaaggaaaagggcagctacaaccatctgatcaagtgcgcatcaatgaagcgagcagctgctcctgtgccggaggcttaaacatctcttccttaatttgatatgtactcgtgtggctttatctactgttcagtgtgttttccttccaaacccttcgatttccattggaaggggtaggcaaaacttggttctgccttcttttttaaaaaaacttctcccttcagctctcggcgaggatgtttgtcgtgtttgattgatagatgggtttcaaactcccaaaattgtaaaatgactggaggaatttcaattgcaaatattggatgctattagtgcttcttacttgtgtatctggttttgttaccacatattacgagggaaaattgtgtcataatatgatatgcgtc

SEQ ID NO: 359 - DNA, 807 bp, Rose
ggacataaggcaattatgctttcattggcacccagcagaatgcaaggcttgtgcaaagacggtttacccagtagaggagctatctgcagatgggatttcctaccacaagtcttgcttcaagtgcactcactgcaaggggactttgaagctgagcaattattcctcaatggaaggtgttctgtactgtaagcctcattttgagcaactcttcaaggagaccggaaacttcaacaagaatttccagtcacctgcaaagtcagctgagaagctaactccagaactgactaggtcacccagcaaagctgctggtatgttttctggcacacaagaaaaatgtgctacttgtggtaaaaccgcttatccactggagaaggtgacggtggagagccaggcctatcacaagtcgtgttttaagtgttctcacggtggctgtcctattactccatcaaattatgcagcccttgagggaattttatactgtaagcaccatttctcccagcttttcaaggaaaaggggagctacaaccatcttattaagtctgcatcaatcaagcgtgcagcagcagcaacagcaacagcaacagcagctgcagcagcagtagcctccattccagaagcctaaatgccaattttatagtttgtttacattgctttcttttgttgaagattgtgttgtttcttagactgtacgcttgtcatggctgagtgagtaaacttcgtctgtcttctctattgtctttggctcaatgaactcgggcacattcttgtgtttgcttgatgtatgtgatgcagagtctgacagctagt

SEQ ID NO: 360 - DNA, 1247 bp, Aquilegia
cacactcgcgcacctcatccactttatctagactctctttctctctcttacttttcctcatttctcttgtttctcactgctgatttatctttcgcttgttccgctcgctgcataattaagctttctccaactctctctctctctatttatttacccattcaattcattcttctcttccgattcttcttttctttaacctctctatcttccaattctttctgctaattctcttttatttattcagaaattgagaagaagaaactagtttgtttgttgaaagcttggatctgttgaagatcgagaagataccgatcggacagctatgtcgttcatcggtactcaggagaaatgtaaggcttgtgataagactgtttatgtgatggatcagttatctgctgatggagtttcttatcataaggcttgtttcaagtgtagtcactgcaaaggaacgttaaagctgagcaattattcctcaatggaaggcgtcctgtactgcaggccccactttgagcagctcttcaaggaatctgggaattttaacaaaaacttccagtcaccggtagcaaagtcggtggagaagttaactccacaaatgacaaggtcacctagcaaagctgctggtatgttttctggaacacaagaaaagtgtgctacttgtggtaaaacggcatatcccctggagaaggttactgtggagaaccaggcctatcacaagtcgtgtttcaagtgctctcatggtggctgctcactatccccttcaaactatgcagcacttgacggcattttgtattgcaaacatcatttctcccagcttttcaaggagaaagggagctacaaccaccttatcaagtgtgcttctatcaagcgttctccaggcactgccacagccgcagctgcagccactgtgccagatgatgcctgatacttcaattctatcaccagagaaattaatttatcatccaatacctgttttttttttttttttttttactatttcgctgctccttcattgatgaagactgtttttgttgtttgtttgttttcaattcattcccctttttatctcatggggaataggcaaacttgattcccctttctctttttcagcttctctttgtttgcaagttaactctagtgtgcacattatgtggaatttgattcttctggtgtcttatgtggaacatttgcaactttgtttgttcttgttacttgcaaatggttttccttagaggttagaggctctctaa

SEQ ID NO: 361 - DNA, 968 bp, B. oleracea
aaaagccaaagtggaaccccactgtctcctccagcaaatagaatccataaaaaggcgaggattttcaccccaatctccgatcttttattcttcttcatcgctttgttcttcatcacacagatcctccattctcctttcgttccttgggaggatcagatcttggaaggtcctcagctcaaggaaaggagaaggggaaagtaaagggatagacttttgaaggatgtcttcattcacgggaactcagcagaagtgcaaggcctgcgagaagacggtgtaccctgtggagcttctctctgctgatggtgttagctatcacaagtcttgcttcaaatgctctcactgcaaatccaggcttcagctgagcagatattcatcaatggaaggtgtgttgtactgtaagcctcattatgagcagctcttcaaggagtctggtagcttcaccaagaactttcagtcmcctgywaaaccggctgagaaatcaaatcctgaactgacaaggactcctagccgagttgctggcatgttctctggtacacaagagaaatgcgccacttgcagtaaaactgtgtatcctatcgaaaaggtaacagtggagagccagacgtatcacaagtcctgcttcaaatgctcacatggaggctgcccgatctcgccttccaactacgcagctcttgaaggaatcttgtactgcaagcaccatttcgcccagcttttcaaggaaaagggtagctacaaccacttgatcaaatccgcttccatcaaacgctctgcagccgccgcagtagccgctggtacaccagcaacggcggttcctgaatcttaaattctgttatcctctcctctatctagtctaaattgaagttaattccaaactgatgcagtttacttttctctttgtgtgtgagtgtgtgttcctttgtttccactgatgtctcctgaagtctttgtgttgttatctgtaagaaaaa

SEQ ID NO: 362 - DNA, 873 bp, Canola
tccattctcctttcgttccttgggaggatcagatcttggaaggtcctcagctcaaggaaaggagaaggggaaagtaaagggatagacttttgaaggatgtcttcattcacgggaactcagcagaagtgcaaggcctgcgagaagacggtgtaccctgtggagcttctctctgctgatggtgttagctatcacaagtcttgcttcaaatgctctcactgcaaatccaggcttcagctgagcagatattcatcaatggaaggtgtgttgtactgtaagcctcattatgagcagctcttcaaggagtctggtagcttcaccaagaactttcagtcccctgttaaacctgcggctgagaaatcaagtcctgagctgacgaggacccctagccgagttgccggtatgttctcaggcacacaagaaaaagcgccacttgcagtaaaactgtgtatcctatcgaaaaggtaacagtggagagccagacgtatcacaagtcctgcttcaaatgctcacatggaggctgccccatctcgccatcaaactacgcagcacttgaaggaatcctctactgcaagcaccatttcgctcagcttttcaaggaaaagggaagctacaaccacttgatcaaatctgcttccatcaaacgctctgcggctgctgcagtcgctgctggtacacctgcagccgccgttcctgaatcttaataaactcaataatcatctctcctctctagtctaaaattgaaaactcaatgccaaactgattcagtttgtttttcgcttttgtgtctttgcgtgtgagtgtgtgtaatctatctctttgttttcattgttgtctccctaaaaagcttgtttgttgtcataactttggtatcta

SEQ ID NO: 363 - DNA, 1015 bp, Radish
actgtctcctccagcaaataaaaaccataaaaaggcgagatttttcacccaatctccgatctttaattcttcttcatcgctttgatcgtcatcacacagatcctccattctctttcgttcctccttggaggatcagatcttggaaggtcctcagctcaaggagaggagaagaagaaggagagtaaagggagagacttttgaaggatgtcttcattcacaggaactcagcagaaatgcaaggcttgcgagaagactgtgtaccctgtggagcttctctcagctgatggtgttagctatcacaagtcttgcttcaaatgcactcactgcaaatccaggcttcagctgagtagatattcatcgatggaaggtgtgttgtactgtaagcctcattatgagcagctcttcaaggagtctggtagcttcaccaagaactttcagtcacctgttaaaccggctgagaaatcaagtcctgagctgacaaggacacctagccgagttgctggtatgttctcaggcacacaagagaaatgcgccacttgcagtaaaactgtgtatcctatcgaaaaggtcacagtggagagccagacatatcacaagtcctgcttcaaatgctcacacggaggctgccctatctcaccatcaaactacgcagctcttgaaggaatcctctactgcaagcaccatttcgctcagcttttcaaggaaaagggaagctacaaccacttgatcaaatctgcttccatcaaacgctctgcggcagccgcagtcgctgccggtacacctgcagccgccgttcctgaatcttaaaaaactcaaataatcctctctcctctctagtctaaattgaaacttcaatgccaaactgattcagtttgttttctcattttgtgtctttgtgtatgagtgtgtaatctatctatcctttgatgttctttgcttccattaatctcttctaaagcttgattgttgtcgtgatttggtatctctataaaaaaaaactgagactttccttttt

SEQ ID NO: 364 - DNA, 1481 bp, Aristolochia
gctgcacggtgcgtttagagccatctctgctgcgctttccccctcttgtttccctacttgcgaagctagtcgggaccgctcaaggaggaaattctgccggtgttgtttgtcgttctgtgtttttagcgtctcttttttttttttttttttctgatgcttttgattattcaagcatcgacgactagggagtaactgtcgatcgaagtattgcatctagtctcgacttggagagagctctctgtcttttcccggtcgaagcttttttcttttttttttttttttgttattttttgttctttttgggggttcgaaattgtttagttcaactggaaggaggctgtgcgatttgaggttttcgtatcagatctggtcggtcgaggacgagagctcgggatctttgattcggtttatctgaagtcgcgcatttgaagatagcgaagagataaggtgtgagatttcctcgcttttgtttgaaagcattgaatctaggagcgatggcgttcttctctggaactcagcaaaaatgtaaggcatgcgagaagaccgtttacgtggttgatcagttaagcgctgatggggtttcatatcataaggcctgctttaaatgtaaccactgcaagggaactttgaagcttagcaattactcttcgctggaaggtgttctatactgcaagcctcacttcgagcaactttttaaggaaactggaagtttcaataagagcttccagtcacccgcgaaaccagttgagaagttaactccagagctgacgaggtcacctagcaaagctgcaagcatgttttctggtactcaagaaaagtgtgctacttgtggtaaaacagcatatccacttgagaaggtaacagtggagggccagccctaccataagtcctgtttcaaatgctcgcatgggggttgtccaatctctccgtcaaactatgctgcccttgaaggaattctttactgcaagcaccatttttcccagctttttaaggagaaagggagttataaccatctcattaagtgtgcatccatgaagcgtccaacgacccctattcctgaagcatgattgtctgtttctccctggacggaaattgaccagtctatgtcattcaactggtgatatgtttctatttttatttactttgctttgaagcagtaaatgtggattccctactttcatgttttcacaatcagtattagagcttttgtttcttctcagccagaacatttacatgaatttggctcgtgtgaaactgatttctgtgtgtcatttgagacgctcagtgtgcagttaaaattttttatgcttcatattgctctcgttagtctgtttctggactgagtgatgtaattcgttgggccatgcccatggatgtgttatctttatctgtgcatgcccgtggatgggttttctttatctgcgcatgcccatggttgggttatctttatcaacgcatgcccatagatgggttatctttaa

SEQ ID NO: 365 - DNA, 1153 bp, B. juncea
acgggaactcagcagaaatgcaaggcttgcgagaagacggtgtaccctgtggagcttctctcagctgatggtgttagctatcacaagtcttgcttcaaatgctctcactgcaaatccaggcttcagctgagtagatattcatcaatggaaggtgtgttgtactgtaagcctcattatgagcagctcttcaaggagtctggtagcttcaccaagaactttcagtcacctgctaaaccagctgagaaatcaagtcctgagctgacaaggacccctagccgagttgctggtatgttctcaggcacacaagaaaaatgcgccacttgcagtaaaactgtgtatcctatcgaaaaggtaacagtggagagccagacgtatcacaagtcctgcttcaagtgctcacacggaggctgccccatctctccttcaaactacgcagctcttgaaggaatcctctactgcaagcaccatttcgctcagcttttcaaggaaaagggaagctacaaccacttgatcaaatctgcttccatcaaacgctctgcagccgctgcagtcgctgctggtgcaccagcagccgccgttcctgaatcttgaaactcaataatcctctctcctctctagtctttaattgaaactcaatgccaaactgattcagtttgttttctcttttcgtgtctttgtgtgtgagtgtgtaatctatgaaacatatctatctctttgtttctatttatatctcctaaaaaccttgtttttgttgtcataacttcggtatctatattaaaaaactgagactttccgtttgactatcaatgtaaagagttacagctttgaagtacgatactggttcactctcatagcgagttcaccattctcgtcagtctcatagcgactgttagctcaagactcataacgtctgtgagtttacaacatacaaagcataatcccccaaatgcatatacaatagctatttatatcctctttctctgtaactgcaaagactctctctgaagtagaagtttctcccttccttgtcattcacttcacttcagactcctcacctggctccacctgttctttacctccttccctgcgaatataaaccttcttgaaccttgatcgaattttgtcgaggaggatgtctctctctctctcttcc

SEQ ID NO: 366 - DNA, 1108 bp, Amborella
aagcaaatatccctccaaaattagggcaccgtgttgggccttgtgctatagtcgaaatctccaatgatcaactatccctaaatcaagtttcaaggattcattttgtttattcgtacgaaagagctgacatttgagcctttgtgaccgatcctttctagattggggccaaaccttggaacttaagcttgggatcttgagattgttactggtggggtccatttttggtattaaaagctcgggagttggggccatggctttcagtggaacacagcagaagtgtaaagcttgtgagaagactgtgtatgtgatggatcagctttcagctgatggggtattgtaccacaaatcttgcttcaagtgcaaccattgcaaaggcaccttgaagctgggtaattattcttccatggaaggtgtgctctactgtaagccgcactttgaacagctctttaaggagactggcagtttcaacaagagctttcagtcacctgcaaaatcagttgagaagctgacgcctgaactgactaggtcacctagcaaagctgcctccatgttttctgggacacaagacaaatgcgcgacttgtggtaaaactgcatatcccttggaaaaggtgactgtagagagtcaatcctatcacaaatcctgcttcaaatgctcccatggaggctgcccaatcactccatcaacctatgcagcactcgaaggcattctttattgcaagcaccacttctctcagctcttcaaggagaaaggcagctacaaccatctcatcaagtgcgctaccatgaagcgacaagctgctcccgttccagaggcttaacaatctgtgttttgtgtgatttttccaggttgtattcgttttgggcccgaaaaacttgggcccccccgtgtggttcatttatgtgggacgcgagttctgggtggttcatggaccgttatatgtgtttgttctgttttgtgagtataattatatgatgtaggtggtatttgcattggatatatgcaaagtttccactacagtattacatatgaaatggcatgtttcacgtgttcttggttggctgccattgaggagctgcaatgtaatttctttgatggattatggctc

SEQ ID NO: 367 - DNA, 768 bp, Cirsium
ctgattgatatataactaaaaccccatttctttacgctgcgtctaaacattccctactatttgacctctgtattcagacaactttgacttccatcaacaaatccaactcaaatttggctgaattcatccaggttttgattgagattgaatctggattaagaaagggtggtgtaaagatttgaagatcagatccaggaggggaaaagggtaattatgtcttttactggaacacagcagaaatgcaaggcttgtgggaagactgtttacccagtggagcttttgtctgctgatggtattgattaccataaatcttgcttcaagtgtagccattgcaaaggtacccttaagctgagtaattactcgtcaatggagggtgtgctctactgcaagcctcacttcgagcagctcttcaaggagagtggaaatttcaacaaaaacttccaatcacctgcaaaggcagcagataagtcatctccaatgctgacaaagtcacctagcaaagctgctggcatgttctccgggacccaagagaaatgcgcaacttgtggcaaaacagcttatcctctggagaaggtaacagtagagaaccaagcataccataaatcatgtttcaagtgctcccatggaggctgctctttatctccatcaaactatgcagcattggagggaatttgtactgcaaacatcatttctcacagctattcaaggagaagggcagctacaatcatctcatcaagtctgcatccatcaagcgctctgcagcagcgg

SEQ ID NO: 368 - DNA, 1320 bp, Cotton
gcttagcgtggtcgcggccgaggtacgcggggatgacaccaacgttgtcaaataatcaaagccaccatagatgagtttggttgaaaacaatgacttgttccatccatcaaaccatataatataatattccttatatattatatatatattattctcttgtttctttgagttatttcccaataatttctcattatctatttcttctctaattccttagaacacccttttgactcttttacagcttttgaactttctctttaatttgatttcattttttgttcatcttatttcatagatccaatacttacttctttcaacgtattaaagaacaaaatattgaattgaagctctagatctaaagcatatattggagccatgtcttttattggtacccaacaaaaatgcaaggcttgtgaaaagactgtttacccagtggaacttgtatcagtagatggggttcctttccataaatcttgcttcaaatgcagccattgcaaagggacattaaagtggggtaattactcatcaatggaaggtgttctttattgcaagcctcatttcgagcagctattcaaggaggcgggtaactacaacaagaattttcagtcacctgccaagtcagccgagaagttaactcaactgacaagatcgcctagcaaagcggctggcatgttttccgggacacaagacaaatgtgctacctgtgggaaaactgcttatccactcgagaaggtaacagtggaaggtcaatcttaccacaaatcatgtttcaagtgctctcatggtggttgccctataagcccttcaaattatgcagcacttgagggcattttgtattgtaagcatcacttttcccagcttttcaaagagaaaggaagctacaatcatttgatcaagtccgcatcgattaagcgcacagccacctctgttccagaagcttcatagaaatccctttttttcatgtttttctttctgttcttgtgtttgctggatttttttccttatgaatcctttgatttatgtttatgaacaaaaaaggggaagaaaaaacttgaatttcctctatggcttattcacctgcagatatgtaatggcattttattgatggatggatatgcaatctccaaattagaatttgtaaaaaaaaaacccttgctttgtttgcatggtaccacatgttgatgtactttcgatgtttgccttgctttaaagtcctctcatctccattttcatgtatatgtatgtatctatgcatgcatgtatgtatgcattctccaaaattagaattttgaaaaacatcccttgcttgcttgcatgata

SEQ ID NO: 369 - DNA, 959 bp, Pepper
gcacgagggccaactaaagatattctctctagctcatattcctaaataaaacattcttctctctccactaaagtcttcatctcccattaatccacaacattaatcagatcaataattttttttatcttccaatatctagaatttcttttttgttgttgttggtgttggaagtgatgtcttttacagggacacaacagaaatgcaaggcatgtgaaaagacagtttacccagttgaacttttgtcagctgatgggattagttatcacaaatcttgtttcaaatgtacccattgtaaagggactcttaagctgagcaattactcgtcaatggaaggtgttctgtattgcaagcctcattttgagcagctctacaaggagtctggcaacttcaacaagaactttcaatcccctgtgaagtcagctgagaagttaactccggagctgacaagatctcctagcaaggctgccggcatgttttctgggacgcaggaaaaatgtgcaacctgtggtaaaacagcttatccacttgagaaggtaacagtggagaaccaaagttaccacaagtcgtgcttcaagtgttctcatggtggatgctcgttaaatccatcaaattatgctgccctcgatgggattttatactgcaaacctcatttttcacagcttttcaaggagaaaggcagctacaatcatttaatcaagtctgcttcaatgaagcgtccagcagcaacagttccagattcttaaactattatctctggcagctattttatcccgagggcttggtctttttatatttgtttgtcttctttttgttgtatctccagttggtgtgccattttggtttactgtgtgatctgagttccacaattgtgaaaacttatcctgtcgctgtttaacttttggatgttaaatgttcctgctgttttctcatgacctttggcacgaaaaaaaacctcgtgc

SEQ ID NO: 370 - DNA, 751 bp, Ambrosia
tttgctctgtgtataacattccctaccattttgacctctgtgttcttcttcttcttcctcatctctgcaactaaatcataacagtcttgactttaatcaacaaagtcaactcaaatttcaacccatcaaaactgttaatttattaagggaggtgaaggaaaagattaaggtcagatccaaaggggaaaagggcaaatatgtcttttattggaacacagcaaaaatgcaaggcttgtgggaagactgtttaccctgtggagcttttgtctgctgatggtattgattatcataaatcttgcttcaagtgtagccattgcaaaggcacacttaagctgagcaattactcatcaatggaaggagtgctctactgcaagcctcactttgagcaactcttcaaggagagtggcaacttcaacaagaacttcacatcacctgcaaaggctgctgataagttatctccaatgctgacaaagtcacctagcaaagctgctggcatgttctcgggtacccaagaaaaatgcgctacctgcggcaaaacagcttatcctttggagaaggtaacagtggagaaccaagcataccacaagtcatgtttcaagtgctcccacggagggtgctctttatctccatcaaactatgcggctttggagggaatcttgtactgcaagcatcatttctcgcagttattcaaggagaagggcagctacaatcatctcatcaagtctgcatccatcaaacgcactgcagcagc

SEQ ID NO: 371 - DNA, 915 bp, Basilicum
tgtttgcagcaacccctccgacgcatacataaacacagccaaagtgggcaatctcacctacgaatttccaactttcatcaatttcgatcaatccctcttcttttagatctagtgattgaaagtgagagaagagaatgtcttttatcgggacacagcagaaatgcaaggcctgcgagaagactgtttatccggtggaattgctgtctgctgatggagttagttatcataaatcttgcttcaaatgctctcattgcaaaggaaccctcaagctgagcagttattcgtcaatggagggtgttctctattgcaagccccattatgagcaacttttcaaggagactggtagtttcagcaagaactttcaatcacctgcaaagtcagccgagaagttaactccagagatgacaagatcacctagcaaagctgcgggtatgttctctgggacacaagacaaatgtgcaacatgtggtaaaacagcttacccactcgagaaggttactgttgaaagccaaagttatcacaagtcttgtttcaagtgttcccatggtggatgctctttgactccatcaaactatgctgccctagacggcattctatactgcaaacctcatttttcgcagcttttcaaagaaaaaggtagctacaaccatttgatcaagtctgcatcgatgaaacgcccaactgctgtggttcctgattcttgaactcaaaaacacatttagtgttttaatatctatttgtatcggcatgagtttggctttgggggtgtgtttgtttgatttttcgttcctgcaaacttggaagtaacttttacctcaatgacttgttttcccagttgagtgatggtggtgatgttaccacaatttgggagatgtttatatttcccatcagtgttttaatgtgataacttattaa

SEQ ID NO: 372 - DNA, 1065 bp, Liriodendron
ctttcatttcgctccttccgctcgctgcaaaaagcgtagaaaaaagagagaagaaaaaaaaaaaaaaatctcagaatcccccaaaaatagctcaaaccctagtctccgccccttttctctcgatctctccttccatttttctggcgattttcgatctctgatcgacagattcatttccggaaagctcgtagatgcgaaaatccgtttcttcagaactctgaatcttcaatcggctgaaatagaagctgtattctctttctgaagagatttctgtcggtttatgctcctttcgcttggattttcttggcaagatcgggagattcagctgcggaagctcttagttgtgaagatctgcgatttccgctgtctagatcttcgatcgatgaaatagaagttgtgttgaccttatcggaagggatatcaatcgatttgtgcttcttgcgtgatcgagacatttggatttttgaagatctgcgatttctgaggttgagaaccgtcagatccaggactaatggctttcagcgggacgcagcagaagtgtaaggcttgcgataagacggtctatgttgttgatcagttgtctgccgatggagttgcttaccataaggcttgttttaaatgcaatcactgcaaaggaacccttaagctgagcaattactcttcactggaaggtgtgctgtactgcaagcctcattttgaacagcttttcaaggaaacaggcagtttcaacaagagcttccagtcgcctgcaaagtcagcagagaagttgaccccagaactgacaagatcacctagcaaagctgctggcatgttttctgggacacaagaaaaatgtgctacttgtggtaaaacagcatatccactggaaaaagtaacggtggagagccaggcctatcacaagtcatgcttcaaatgctcccatggcggttgtcccatatccccatcgaactatgcggccctagaaggcatcttatactgcaagcaccatttctcccagcttttcaaggagaaagggagctacaaccatcttatcaagtgtgctaccatcaagcgcacatcagctac

SEQ ID NO: 373 - DNA, 953 bp, Canola
gccagcaaatagaatccataaaaaggcgagatttttcaccccaatctccgatctttttattcttcttcatctctttgatcgtcatcacacagatcctccattctcttttcgttcagatcttggaaggtcctcagctcaaggagaggagaagaggaacgtaaagactttgaaggatgtcttcattcacaggaactcagcagaagtgcaaggcttgcgagaagacggtgtaccctgtggagcttctctctgctgatggtgtcagctatcacaagtcttgcttcaaatgctctcactgcaaatccaggcttcagctgagcagatactcatcaatggaaggtgtgctgtactgtaagcctcattatgagcagctcttcaaggagtctggtagcttcaccaagaactttcagtcccctgttaaacctgcggctgagaaatcaagtcctgagctgacaaggacccctagccgagttgccggtatgttctcaggcacacaagaaaaatgcgccacttgcagtaaaactgtctatcctatcgaaaaggtaacagtggagagccagacgtatcacaagtcctgcttcaagtgctcacacggaggctgcccaatctcgccttcaaactacgcagctcttgaaggaatcctctactgcaagcaccatttcgctcagcttttcaaggaaaagggaagctacaaccacttaatcaaatccgcttccatcaaacgctctgcagctgctgcagtcgctgctggtgcacctgcagccgccgttcctgaatcttaataaactcaataatcctctctcttctctagtctaaaattgaaaactcaatgccaaactgattcagtttgttttctcttttgtgtctttatgtgtgagcgtgtgtaatctatctctttgtttacattgttatctcctaaaaagcttgtttgttgtcataactttggtatctatata

SEQ ID NO: 374 - DNA, 921 bp, Radish
attcttccttcatcgctttgatcgtcgtcacacagatcttccattctctttttgtgccttggaggatcagatcttggaaggtcctcagctcaaggagaggagaagaagaaggagagtaaagggagagacttttgaaggatgtcttctttcacaggaactcagcagaaatgcaaggcttgcgagaagacggtgtaccctgtggagcttctctcagctgatggtgttagctatcacaagtcttgcttcaaatgcactcactgcaaatccaggcttcagctgagtagatactcatcaatggaaggtgtgttgtactgtaagcctcattatgagcagcttttcaaggagtctggtagcttcaccaagaactttcagtcacctgttaaaccggcggctgagaaatcaagtcctgagctgacaaggacccctagccgagttgctggtatgttctcaggcacacaagaaaaatgcgccacttgcagtaaaactgtgtatcctatcgaaaaggtaacagtggagagccagacatatcacaagtcctgcttcaagtgctcacacggaggctgccctatctcgccatcaaactacgcagctcttgaagggatcctctactgcaagcaccatttcgctcagcttttcaaggaaaagggaagttacaaccacttgatcaaatctgcttccatcaaacgctttgcggcagccgcagtcgctgccggtacacctgcagccgccgttcctgaatcttaaaaaactcaaataatcctctctcctctctagtctaaattgaaacttcaatgccaaactgattcagtttgttttctcattttgtgtctttgtgtatgagtgtgtaatctatcctttgatgctctttgcttccattaatctctcctaaagcttgtttgttgtcgtgatttggtatctcta

SEQ ID NO: 375 - DNA, 1001 bp, Radish
aatcttccgatcttttattcttccttcatcgctttgatcgtcatcacccagatcctccattctccttcgttcctccttggaggatcagatcttggaaggtcctcagctcaaggagaggaggagaagaagaagggtgaggagagagagagagagactttgaattgaaggatgtcttctttcacaggaactcagcagaaatgcaaggcttgcgagaagacggtgtaccctgtggagcttctctcagctgatggtgttagctatcacaagtcttgcttcaaatgcactcactgcaaatccaggcttcagctgagtagatattcatcaatggaaggtgtgttgtactgtaagcctcattatgagcagctcttcaaggagtctggtagcttcaccaagaactttcagtcacctgttaaaccggcggctgagaaatcaagtcctgagctgacaagaacccctagccgagttgctggtatgttctcaggcacacaagaaaaatgcgccacttgcagtaaaactgtctatcctatcgaaaaggtaacagtggagagccagacatatcacaagtcctgcttcaagtgctcacatggaggctgccctatctcaccatcaaactacgcagctcttgaagggattctctactgcaagcaccatttcgctcagcttttcaaggaaaagggaagttacaaccacttgatcaaatctgcttccatcaaacgctctgcggcagccgcagtcgctgctggtacacctgcagccgccgttcctgaatcttaaaaaaaactcaaataatcctctctctattctctagtctaaattgaaaactcaatgccaaactgattcagtttgttttctcttttatgcctttgtgtatgagtgtgtaatactgtaatctatcctttgatgttctttgcttccattaatctctctcctaaagcttgtttgttgtcgttatttggtatctctattaaaaaaaactgagactttcctttttcgaatcaaga

SEQ ID NO: 376 - DNA, 1219 bp, Amorphophallus
ctctccatttcgctcctgctgcatctgctcggcgcagaaaggtccattccatccgccgcagcgatcatctccggcctgctctttgcttccctctccctctctccggtcattctccggcggatctctgccgtaggatcggagcagcttcccgctgtcggcggcgggcgaccggcggatctgtaggctgtaggggcgctgttccagatcgggtgttggtggaaaccgttccccggataggaattgcgaagtcgtgggtgggggatttgatcgggtggggtaggcaggtgagggggggagatcggaccagtttggggaggtcggcgtcggggcggcgagaagcatggcgttcctgggcacgcagcagaagtgcaaggcgtgcgacaagacggtgtacgtgatggaccagctgaccaccgacggcgtcgtctaccacaaatcctgcttcaaatgcaaccactgcaagggcactctcaagttaagcaattactcttccatggagggtgtgctgtattgcaagcctcactttgaacagctcttcaaggagacaggcaacttcaacaaaaactttcagtcgcctgcaaaggcggctgagaagttaactccagagctgacaaggtctcccagcaaagctgctagcatgttttctgggacacaggaaaagtgtgccacttgtggtaaaacagcatatccacttgaaaaggtaactgtggaaggtcaagcttatcacaaatcttgtttcaagtgctcccatggggggtgttcaatcacaccatcaaactatgctgccctagaaggcatcctatactgcaaacaccatttctcccagctttttaaggagaaaggaagctacaatcatcttatcaaatgtgcttcggtaaagcggccagtaactcctgcccctgattcctgatctatatttctccatgctctgcattcagtacctttgctctggactaccatgtccagtgtctgcagtccacaagtttttttctatatttattttggtttgctttcctgttggatggctagcatcctacatttggtttgttttccctaagcagtgtgagactctcgtgctgtatgatcccctcaatttgtatttcatgcaactttctatgcctcacgtgtgacccggattgattatgaaaagtgtgaatctactatatgccttcagaaatgtatattttgtttgtttatcttgggctttgcttacgaacac

SEQ ID NO: 377 - DNA, 806 bp, Antirrhinum
atttccattaactagcatcatatcatatcctctttttcatttaatttcacatatatacatacmcttagtggggagcctttaacccaccatttcaacaaatcttgattcaccaaagaaagttgtttagaagtgaaattgggttctcagatctgctgctgtttgagttaaaagggatatgtcttcttttactgggacacagcagaaatgcaaggcctgtgagaagacagtttatcctgtggagcttttgtctgctgatggaatcaattatcacaaatcttgcttcaaatgctctcactgcaaagggaccctcaagctgagcagttactcgtcaatggaaggtgtactctactgcaagcctcactatgagcagcttttcaaggagactggcagtttcaccaagaactttcaatcacctgcaaagtcagctgagaagttgactcctgagctgacaagatcacccagcaaagctgctggtatgttttctgggactcaagacaaatgtgctacttgcgggaaaacagcttacccactagagaaggtaacagtggaaaaccaaagctaccacaagtcttgtttcaagtgttctcatggagggtgttctctaacaccgtcgaattatgcagcattgaacggcgttctgtactgtaagcctcatttttcgcagctgttcaaagaaaagggcagctacaaccatttaaacaagtcttcatcaatgaagcgtccaactgccgttgttcctgattcttaaaagcaagctatatgccttactatctatgatacacsggcgtacttgtttgagtgtgttc

SEQ ID NO: 378 - DNA, 1183 bp, Catharanthus
ctcggcatatacgcattccctgttttaaatattattaaaaatccataatttggcttctgcatttgcgctagttaaagtcttgaaaaattcttttttttgactttgatctcaagctgttgcatatcaaggagctcttagatcaaagcccagaatctctttcttctgaaaaagagttgaatctaggacgagaggaagtagttgagtaattgaagggttggaattaaaagggtcgcaggtcacagatctagcgattagcattttcttttttgaagttgaaagctatgtctttcattgggacacaacagaaatgcaaggcctgtgagaaaacagtgtatccagttgagcttttgtctgctgatggaattagctatcacaaatcttgcttcaaatgttctcactgcaaaggcactctcaagctaagcagttactcttccatggaaggtgttctctattgtaaacctcattatgagcagctattcaaggagactggcagttttagcaagaacttccaatcaccggcgaagtcagctgagaagttaacccctgagctgacaaggtcacctagtaaagcggctggcatgttttctgggacacaagataaatgtgcaacttgtggcaaaacagcttatccattggaaaaggttacggtggagagccaaagctatcataagtcatgcttcaagtgttcccacggtggatgctctctgtctccatcaaattatgcagcactaaatggtgttttatactgcaaacctcatttttctcagcttttcaaggagaaaggcagttacactcatgtactcaagtctgcctccatgaagcgcccaacaacaccggttccagattcttgaacattttacctcgtcatacttgttctatctgtacgggattgctttgctctgagtgtctttccttgttctttctcctttgttccaacaagcttggggatttatgacatacttacatgccttgtgggctgaaatttctaccattttgagtactctgtcattgttgtttgtctattcttgggatgttcataatcccagatttggcagctgatttattgtttaaatgtcaatgctggtggtggctgtctacaagatcgactcaatagagttcatttaatactatactctcgtgcatttgagcaacctgcacctccttttcatttctcttcaatgac

SEQ ID NO: 379 - DNA, 839 bp, Cynara
  misc_feature (732)..(732): n is a, c, g, or t
  misc_feature (742)..(742): n is a, c, g, or t
gcgggagaaaaagtggatgattagttttcagccaaaagatattccatttcatcttctctttctcttctctctccatcttcttccctgcaaaacaaccataaaaacccatttcttttcctacattttcacctctgattcttcatcactctgcaaacaaacaaaaaaaccttccagtttcagacaaagtgtttgaatctatcaagggatatcaagatcaaacccaagggagaaaagggtaattatgtcttttattgggacacagcagaaatgcaaagcttgtggaaagactgtttatccagtggagcttttgtctgctgatggtgttgattatcataagtcatgcttcaagtgtagccattgcaagggaacccttaagctgagcaattactcgtcaatggaaggtgtattatactgtaaacctcacttcgagcagctgttcaaggagagtggaaatttcaacaagaacttccaatcacctgcaaagtctgctgagaaattaacgccacagctgacaaagtcacaaagcaaagctgccggtatgttttctggcacccaagacaaatgtgctacttgtggcaaaacagcttatcctcttgagaaggtgacagtggagaacgaagcatatcacaagtcgtgttttaagtgctcgcatggaggatgctcgttatcgccatcaaactacgcagcacttgaaggaattttatactgcaagcatcatttctcgcagctatntaaggagaangggtagtacaatcatctcgtcaagtccgcaacatcaaacgctctgccgcacagaagcgcagccgcatccgcgcagccacggtgtcctgaagctgaac

SEQ ID NO: 380 - DNA, 989 bp, Euonymus
gaagaagaagatatttctcctatgtcaaaaatatccttttctgtcatcatcatcatccacttcgctgcatccggtcgctgcaaaagaggcgcctactcctccgcttttcggacaccataagagagaataaggagtttgtgctcgatcgcgctccacctgatccatcgtcactgatttcgacacgaagttgtgttagatttgatttgtggcggtgatcttgtggagatagaaattagccagatctaaaatagcagccatgtcttttattggcacccaagagaaatgcaaggcttgtcaaaaaactgtgtatcctgtggaacttctatccgctgatggggttaattaccacaggtcttgcttcaagtgtactcactgcaaagggacactaaagctcagcaattattcctcaatggaaggtgttctgtactgtaagcctcactttgagcagcttttcaaagcaacgggtaatttcaacaagaactttcagtcacccgcaaagtcagctgagaagttaactcctgagctgacaaggtcacctagcaaggctgccagcatgttttctgggacacaagagaaatgtgccacctgcaataaaactgcttatccagtggagaaggtaacagtggagggcaagtcctatcataaatcttgtttcaagtgttctcacggtgggtgtcctatatctccatcaaattatgcagctcttgagggcattttgtattgtaagcaccatttctctcagcttttcaaagagaaggggagctacaaccaccttattaagtctgcatcaatcagacgtgcggcagcttctgttccagaagcttgagttcgagttcctttatcatctgttttatgatttttctgtgttgtggacgtatttgttgtggttcattgatctgtactcctacatctgtaaactgacttttggaagcattgttggctggtgggtatcttgccggcattgggatcaaattactacttatcttgct

SEQ ID NO: 381 - DNA, 977 bp, Orobanche
atcattgtatctattgcacgaagtaggggagcctttaaccaccattttccgtccccccccttttttcgtatttttttttcctgctcggacttcatattgattcagaagctcgactgatttgctaagagggcaaatatgtcatttattgggactcagcagaaatgcaaggcctgtgagaagactgtttatccggttgagctgttgtctgctgatggagttagttatcacaagtcttgcttcaaatgctctcattgcagaggaaccctcaagctgagtacttactcatcaatggagggtgtgctgtactgcaagcctcactatgagcagcttttcaaggagactggcagtttcaccaagaattttcaatcgcctgcaaagtcagctgagatgttaactccagagtttacgagatcacccagcaaagctgcgggtatgttttctgggacacaagacaaatgtgcaacatgcggtaaaacagcttacccattggagaaggtgacggtagaaagccaaagctatcacaagtcgtgtttcaagtgttgtcatggcggatgctctctgtctccgtcaaactatgctgccttagacggcatcttatactgtaaacctcatttttcgcagctcttcaaagaaaaggggagctacaaccatttaatcaagtcagcatcagtgaaacgtccagtggctgttgttcctgattcttgaatgtagcatgtttaagcgcattactattagttatctatctatttacatacatgtgcgtgcttgggttttttatttccatctcattctgttcgattttcgtgcaaacttgaatttattttttcccaactgggagtcttctttttccatctcattccagctgagtggaactgctggcgggtgttgaaattcaaattcatgggatgttcaaattccagcaactgtgttcttaaggcgactattgaaattcatataccgttgctaatgacaacctt

SEQ ID NO: 382 - DNA, 1081 bp, Phlya
acattgttgtggagtatcttcgttgtaggagtcaaactgcgcagatatttaccatctctctctatccacaatcatcattattcttcatcatctcgtgcgctctcccttgtcgagaacgcataagtaaagtgggattcgaggtggggagtcctatccaccaattttgaacttttacggcttttcgtcaagcaccttgattgctttttccctcttctttcgagttaattattaagactgttacagatctattgatttttggtgggttgaaagaggtatagaagaacaatgtctttcactgggacgcagcagaaatgcaaggcctgtgagaagactgtttatccggtggaattgttgtccgctgatggagttagttatcacaaatcttgcttcaaatgctcccattgcaaaggaaccctcaagctgagcagttattcttcgatggagggtgttctctattgcaagccccactatgagtaacttttcaaggagactggcagtttcaccaagaactttcaatcacctgcaaagtcagctgagaagttaaccccagagatgacaagatcgccgagcaaggcggcaggcatgttctctgggacacaagaaaaatgtgcaacgtgcggtaaaacggcttacccacttgagaaggtgactgttgaaagcctgagttaccacaagtcttgtttcaagtgttctcacggaggatgttccctaactccatcaaactatgcggccctagacggcatcctatactgcaagccccatttttcgcagctcttcaaagaaaaggggagctataaccatgtgctcaagtctgcatcaatgaaacgcccgactgctgttgttcccgactcttgaacacgatgcgcctttagttttttactatatcggcacgagcttgcctgtgtgggtgtgtttttcgacatatttctgtttgatttcgattcctgcaacttggaggtaacttttccttcagctgagtgtattgcattcattgctggcgctgttaacacaagtttgggggaagttatgtttcccctcactgtttttaatgccatatttaaattcacaaacaaaaaagaaa

SEQ ID NO: 383 - DNA, 1017 bp, Tobacco
gatgaacccagaattttaaaatcctccccaatttctcctccattttatcaacttgactttgatcatcacataaaaatttcgtgacaggcttgtagatcaacaaattcaagagtcgaatctgagctggggaaaaggaagatctagagttttatttgtcattagaagaactatgtcttttattgggacacaacagaaatgcaaggcctgtgaaaagacagtttacccggtggagctgttgtcagctgatggggttaattatcacaagtcttgcttcaaatgcagccattgcaaaggaacacttaagctgagcaatttctcctcaatggaaggtgttctgtattgtaagccccattttgagcagcttttcaaggagtcgggcaacttcaacaagaactttcaatcacctgcaaagtcagctgagaaattaactccggagctgacaagatcgcctagtaaagctgccggcatgttttctggcacacaggaaaaatgtgcgacttgtggtaaaacagcttacccacttgagaaggtgacagtggagaaccaaagttatcataagacatgtttcaagtgttctcatggtggatgctctttatctccttcaaattatgccgccctaaatgggattttgtactgcaaacctcatttttcacagcttttcaaggagaaaggcagctacaatcatttgatcaagtctgcctcgatgaaacgtccagctgcaaccgttccagattcttaaactccatgtttcagtcaactactttatcaatccacatggatttgataattcttgagtgtgtttcttgcgctttctttgttcattagctggtaaccttatcattttgggttactggtttatatgtgtttgaccatcgtgaaggctgttatcctgatttattgtatcatttaacttttggatgttgaaattcctgcccctatcaaatgatctttggcaggagctaattgtgtgatacataacagtgttgttacttactagtattcttctgttactcttct

SEQ ID NO: 384 - DNA, 1029 bp, Triphysaria
gtttccagcgcagctacaccaaataaacaaaaaatatccatcaatcatcaacattattcttcatcattcgttgttgccacatcgtataaagtttggagcctcaatccaccatttttatcttatgatattctcgtacttgacatcgatcaagaaaattgacttcttcttcttcaaagagttgagtatataggccgtgtagcagatctgttggtttttgtttgagttgaaaagggcaaaaatgtcttttatcgggacacagcagaaatgcaaagcctgtgagaagactgtttatccagttgagctcttgtctgctgatggggttgattatcataaatcttgcttcaaatgctctcattgcaagggcactctcaagctgagcaattactcatcgatggagggtgtggtgtactgcaagcctcactatgagcagcttttcaaggaagccggcaatttcactaagaattttcaatctcctgcaaagtcggctgagaagttaagtccagagtttacaagatcacctagcaaagctgcgagtatgttttctgggacagtagacaaatgtgccacatgtggtaaaacagcttaccctctcgagaaggtaagcgtggagaaccaaagctatcacaagtcgtgttttaagtgctctcatggcggatgctcattgacaccatcaaactatgcagcactagacggcatcttatactgcaaacctcatttttctcagctcttcaaagagaaaggcagctacaaccatgtgctcaagtctgcatccatcaaacgtccggctgctgttgttcctgattcttgaacgcccctcgtctttatttatctatcatgtgcttcgcgcctgtgtgtgtatttttttctctcgaacttttttgcaaacttgaagtgattgtttttatacctgtcttgtgttcttctcccagctgagtgtactactgtactgctggcatttttaaacattgtaacttggatgttcaaattttcaaacagcatttttatggaaaaaatactgaaagtcataca

SEQ ID NO: 385 - DNA, 771 bp, Vinca
agagttgaagtaaaagggttggcataagttcagatctagagataagaaaagcagtagcattttcatttttgaagttaaaaaagctatgtcttttactgggactcaacagaaatgcaaggcctgtgagaaaacagtgtatccagttgagctcttgtctgctgatggaattagctatcacaaatcttgcttcaaatgttctcattgcaaaggcactcttaagctgagcagttactcgtctatggaaggtgttctgtattgtaaacctcattatgaacagctgtttaaggagactggcagtttcaccaagaacttccaatcgcctgcaaagtcggctgagaagttgactcctgagctgacaaggtcacctagcaaagctgctggaatgttttctggaacgcaagataaatgtgcaacttgtggtaaaacagcttacccattggaaaaggttacagtggagaaccaaagctatcacaagacatgcttcaagtgttctcacggtggatgctccctgtcaccatcaaattatgcagcactgaaaggcgttttatactgcaaacctcatttttctcagcttttcaaggagaaaggcagttacacccatgtactcaagtctgcctccatgaagcgcccaacaacacctgttcctgagtcttgaacacttctctcatgacaccttctatttgtatgggattgctttgctctgagtgtgtttcattttctttgttccgagcctgtggatttaacacatacaccgaaatttctaccattttt

SEQ ID NO: 386 - DNA, 1047 bp, B. rapa
aaaggcgattagacaaaagccaaagtggaaccccactgtctcctccagcaaatagaatccataaaaaggcgagatttttcaccccaatctccgatctttttattcttcttcatcgctttgatcgtcatcacacagatcctccattctcttttcgttcagatcttggaaggtcctcagctcaaggagaggagaagaggaacgtaaagactttgaaggatgtcttcattcacaggaactcagcagaagtgcaaggcttgcgagaagacggtgtaccctgtggagcttctctcagctgatggtgtcagctatcacaagtcttgcttcaaatgctctcactgcaaatccaggcttcagctgagcagatactcatcaatggaaggtgtgctgtactgtaagcctcattatgagcagctcttcaaggagtctggtagcttcaccaagaactttcagtcccctgttaaaccggcggctgagaaatcaagtcctgagctgacaaggacccctagccgagttgccggtatgttctcagggacacaagaaaaatgcgccacctgcagtaaaactgtgtatcctatcgaaaaggtaacagtggagagccagacgtatcacaagtcctgcttcaagtgctcacatggaggctgcccaatctcgccttcaaactatgcagctcttgaaggaatcttgtactgcaagcaccatttcgctcagcttttcaaggaaaagggaagctacaaccacttgatcaaatccgcttccatcaaacactctgcagctgctgcagttgctgctggtgcacctgcagccgccgttcctgaatcttaaaactcaataatcctctctcctctctcctctctagtctaaaattgaaaactcaatgccaaactgattcagtttgttttctctttcgtgtctttgtgtgtgtaatctatctctttgtttccattaatctatcctaaagattgtttgttgtcgttatttggtatctataaaaaaactgagactttcctttgtgtggaagcgttctatttcagtgatgtttcgttgtgc

SEQ ID NO: 387 - DNA, 1040 bp, Radish
ggggaaccccactgtctcctccagcaaataaaaaccataaaaaggcgagatttttcacccaatctccgatcttttattcttcttcatcgctttgatcgtcatcacacagatcctccattctccttcgttcctccttggaggatcagatcttggaaggtcctcagctcaaggagaggagaagaagaagaagaagaagggtgaggagagagagacttttgaaggatgtcttcattcacaggaactcagcagaaatgcaaggcttgcgagaagacggtttaccctgtggagcttctctcagctgatggtgttagctatcacaagtcttgcttcaaatgcactcactgcaagtccaggcttcagctgagtagatattcatcgatggaaggtgtgttgtactgtaagcctcattatgagcagctcttcaaggagtctggtagcttcaccaagaactttcagtcacctgttaaaccggttgagaaatcaagtcctgagctgacaagaacccctagccgagttgctggtatgttctcaggcacacaagagaaatgcgccacttgcagtaaaactgtctatcctatcgaaaaggtaacagtggagagccagacttatcacaagtcctgcttcaagtgctcacatggaggttgccctatctcaccatcaaactacgcagctcttgaaggaatcctctactgcaagcaccatttcgctcagcttttcaaggaaaagggaagttacaaccacttgatcaaatctgcttccatcaaacgctctgcggcagccgcagtcgctgctggtacacctgcagccgccgctcctgaatcttaaaaaaactcaaataatcctctctcctctctagtctaaattgaaaactcaatgccaaactgattcagtttgttttctcttttatgcctttgtgtatgagtgtgtaatactgtaatctatcctttgatgttctttgcttccattaatcactctcctaaagcttgtttgttgtcgttatttggtatctctataaaaaaactgagactttcctttttcga

SEQ ID NO: 388 - DNA, 955 bp, Radish
aatcttccgatcttttattcttcttcatcgctttgatcgtcatcacmcagatcctccattctccttcgttcctccttggaggatcagatcttggaaggtcctcarctcaaggagaggagaagaagaagaagggtgaggagagagagagtttgaaggatgtcttctttcacaggaactcagcagaaatgcaaggcttgcgagaagackgtgtaccctgtggarcttctctcagctgatggtgttagctatcacaagtcttgcttcaaatgcactcactgcaagtccaggcttcagctgagtagatactcatcaatggaaggtgtgttgtactgtaagcctcattatgagcagctcttcaaggagtctggtagcttcaccaagaactttcagtcacctgttaaaccggcggctgagaaatcaagtcctgagctgacaaggacccctagccgagttgctggtatgttctcaggcacacaagagaaatgcgccacttgcagtaaaactgtctatcctatcgaaaaggtaacagtggagagccagacatatcacaagtcctgcttcaaatgctcacacggaggctgccctatctcaccatcaaactacgcagctcttgaagggattctctactgcaagcaccatttcgctcagcttttcaaggaaaaggaagctacaaccacttgatcaaatytgcttccatcaaacgctctgccgccgccgcagtcgctgccggtacacctgcagccgccgtacctgaatcttaaaaaactcaaataatcctctctctattctctagtctaaattgaaaactcgatgctaaactggttcagtttgttttctcagtttgtgtcttttgtgtatgagtgtgtaatctatctatcctttgatgttctttgcttcctttaatctctcctaaagcttgtttgttgtcgtgatttgctatctctataaaaaaact

SEQ ID NO: 389 - DNA, 1481 bp, Pigeonpea
cctttctctctctctctcttgttatctatatagccaaacaaaccaagcagcattataatagaagaggacacaagctatagccataaggagaaacactttgagaggtgaaagcaaaaagagttcttcatttcttttttatatatactcgtctgctaaagtttcactcacaagccaaatatggcaactatcctgggaaaggagagtggtctcaacctcaaggagactgaactttgcctcggtttgcctggcggaggcggcgtcggcggtggcggtggcggtggcggtggcggtggtagctctgaggtggaaactcctagggccactgggaagagagggttctctgagacagttgatctgaagcttaatcttcaatccaaggaagatctgaatgagaatctgaagaatgtctcaaaggagaagaccctccttaaggatcctgccaagccaccagctaaggctcaagtggttggttggccaccagtgaggtcatacaggaagaacatgatggcacagaaggttagcactgaagatgtcgctgagaagacaacaagcagcactgcttctggggcatttgtcaaagtttccatggatggagcaccttaccttcgcaaggtcgacctcaccatgtacaaaagctacaaagacttatctgatgccttagccaaaatgttcagctccttcaccatgggtaactatggggcccaaggaatgatagacttcatgaatgagagcaagttgatggatcttcttaacagctctgagtatgtgccaacctatgaagataaggatggtgactggatgctcgtgggtgatgtcccatgggagatgtttgttgagtcatgcaagcgtctgcgaataatgaaaggatcagaagcgattgggcttgcgccaagagcaatggaaaaatgcaaaagcagaagctgaagctggccaaatacatgttctatgagattccgtaccaaagtggacctataaaaaagatatatgaagcacttctgctgagactatggagcggagtgttgttagtttgaagaatgtgtctgtggtttttgttttgttcgttcgtatatagattcaactttaattttaaggagcctatggggcatttgtaatggacaagaagcaataaacttaacctatatagtctggcttgtttattatgtgatccttccatgctgtcatgattgttgtgtgctaaataccttgaattttaatgcatactttattccctcaagagattcttcatgtatcttttattttcattttatgttttaattaattctgtacgtcctgcaaaatgatcaatgtctcagctggatgagtaaggtattaaatttttatatggttcccaagtgagcaaggggaacaagcccatgtgcatgttaatggagtttcttgatgggcattagttttatagtctttgtcatctagttttgcaagatcaaatgggtattaactaggtgggtgaatgtagggttggt

SEQ ID NO: 390 - DNA, 1478 bp, Bean
tctctctctctctcttgtaatctatatagccaaacaaaccaagcaccattataatacaagaggacacaagaaaggggaagctacacacactttcatagaggtgaaaccacaacagttacagttattcttttccttgtttatatactctgctgctaaacctctgtcacttcattgagaagcctcaaatggcaactatgctgggaaaggagcatcatctcaacctcaaggagactgagctttgcctaggtctgcctggtgctggtggtggtggtggttctggtggtggcggcggctctgaggtggaaacaccaagggctactgggaagagagggttctctgagacagttgatctgaagcttaatcttcaggccaaggaagatctcaacgagaatctgaagaatgccccagaggagaagactctccttaaggatcctaccaagcaacctgctaaagctcaagtagttggttggccaccagtgaggtcatacagaaagaacatgatgacccagaaggttagcactgaggatggagctgagaagacaacaagcagcactgcttctggggcatttgtcaaagtttccatggatggagcaccttaccttcgcaaggtggacctcacaatgtacaaaagctacaaagacttatctgatgccttggccaaaatgttcagctccttcaccatgggtaattatggggcccaaggaatgatagacttcatgaatgagcgcaagttgatggatcttcttaacagctccgagtatgtgccaacctatgaagataaggatggtgactggatgctcgtgggtgatgtcccatgggagatgtttgttgagtcatgcaagcgtctgcgaataatgaaaggatcagaggcaattggacttgcgccaagagcaatggaaaaatgcaaaagcagaagctgaaggtggcgaaatacatgatgtgtgagatccgtaccaaattggagctataaaaagaaatatgtgaagcactctgcagagactatggagcggagtgttgttagtttgaacgtgtttgtgtcttttttttgttttgttttgttcgtatatagattcaactttaattttaaggagtttatggagcatttgtaatggacaagaagcaataaacttaacctatatagtctggcttgtttattatgtgatccttccatgctgtcatgattgttgtgtgctaaataccttgaattttaatgcatactttattccctcaagagattcttcctatatcatttagtttgattttatgttttaattagttgtgtatgtcctgcaaaatgatcaatgtctcagctggatgaagaaggtattaaatttttatatggttgagaaatgagcaagggaacaagcccatgtgcatgttcaaggagtttctttgatggccattagttttctagtctttgtcatctagttttgcaatatcaaatgcgtattaactaggtgggtgaatgtagggttggt

SEQ ID NO: 391 - DNA, 1222 bp, Cowpea
ctaatctatatagccaaaccaaaccaagcaccattataatacaagaggacacactttcaaagaggtgaaacaaccgcaacacttattctttgccttctttttaaatactctgctgctaagctgtgtcagttcattcacaagcctcaaatggcaactatgctggcaaaggaccatgctctcaacctcaaggagactgagctttgcctcggtctgcctggtgctggcggcggtggcggtggcggcgggggcggcggcggctctgaggtggaaacaccaagggctactgggaagagagggttctctgagaccgttgatctgaagcttaatcttcaggccaaggaagatctcaacgacaatctgaagaatgcctcagaggagaagaccctccttaaggatcctactaagcaaccggctaaggctcaagtggttggttggccaccagtgaggtcatacagaaagaacatgatgagccagaaggttagcagtgaggagggagctgagaagacaacaagcagcactggttctggggcatttgtgaaggtttccatggacggagctccttatcttcgcaaggtggacctcacaatgtacaaaagctacaaagacttatctgatgccttggccaaaatgttcagctccttcaccatgggtaattatggggcccaaggaatgatagacttcatgaatgagcgcaagttgatggatcttcttaacagctctgagtatgtgccaacctatgaagataaggatggtgactggatgctggtgggtgatgtcccatgggagatgtttgttgagtcatgcaagcgtctacgaataatgaaaggatcagaggcaattggacttgcgccaagagcaatggaaaaatgcaaaagcagaagctgaaggtgacaagatacatgatgtgtgagattccgtacgaaattggagctataaaagaaatatgtgaagcacttctgctgagactatatggagcggagtgttgtttttagtttgaacgtgtttgtgtctttttttcttttttgttttgttttgttggtatatagattcaagtttaattttaaggagcctatggagcatttgtaatggacaagaagcaataaacttaacctatatagtctggcttgtttattattattattattattatgtgatccttccatgctgtgatgattgttgtgtgcaaaataccttgaattttaatgcatactttattccctga

SEQ ID NO: 392 - DNA, 1444 bp, Soybean
aacaaaccaagcaacattataatagaaagaggacacaagagaaagaagggggagctatagccataaggagaaaaactttcaaagaagtgaaagcaaaaaagagttgttcttttcctttctgctgataagctgtgtgagtgagttcattgacaagcctgaaatgacaactatgctgacaaatgagcatggtctgagtttgaacctcaaggagactgagctttgcctcggtttgcctggcgggggctctgaagtggaaactccaagggccactgggaagagagggttctctgagaccgttgatctgaagcttaatcttcagaccaaggaagatctgaatgagaatctgaagaatgtctcaaaggagaagactctccttaaagatcctgctaagccgccggctaaggctcaagtggttggttggccaccagtgagatcatacaggaagaacatgatggcagtacagaaggttagcaatgaggaagtagctgagaagacaacaagcagcactattgctaattctggggcgtttgtcaaggtttccatggatggagcaccttaccttcgcaaggtggacctcacaatgtacaaaagctacaaagacttatctgatgccttggccaaaatgttcagctccttcaccatgggtaactatggggcccaaggaatgatagacttcatgaatgagagcaagttgatggatcttcttaacagctctgagtatgtgccaacctatgaagataaggatggtgactggatgctcgtgggtgatgtcccatgggagatgtttgttgggtcatgcaagcgcctgcgaataatgaagggatcagaagcgattggccttgcgccaagagcaatggaaaaatgcaaaagcagaagctgaagctggcctaatacaatgttctatgagagatcccgtaccaaagtggacctataaaagaaattatatgaagcacttcagcgagactatggagcggagtgttgttagtttgaatgtgtctggtgttttttgttttgttcgtatatagattattcaacttttaattttaaggagccgatcgatggggcatttgtaatggacaagaagcaataaacttaacctatatagtctggcttgtttattatgtgatccttccatgctgtcatgattgttgtgtgctaaataccttgaattttaatgcatactttattgcctcaaagagattcttcatatatcatttattttgattttttgttttaattaattgtgtatgtcctgcaaaatgatcaatgtctcagctggatgaggaaggtattcaatttttatatggttcacaagtgagcaaggggaacaagcccatgtgcatgttgatggagtttcgtttatggccattagttttatagtctttgtcatctagttttgtaatatcaaatgggtattaactaggtgggtgaatgtagggttggt

SEQ ID NO: 393 - DNA, 1152 bp, Lotus
ccataattgaagggctcatcagtttctctctcttctagcatatatagccaaaccaaggtgcattataatagaagaagatacaacaaaggaacgggaactatacccaaaggagaaaacactttgagagaattagggggaagagaaaaagtttttattttcctcttattgaaaatctggtgctaagaaaagcactttcagattcattgagaagccaaaaatggctactttgttgggaaaggtgcagaatgatttgaacttgaaggagactgaactatgcctgggtttgcccggtggtggtggtggcggcggtggctctgatcaggtggaaactccaaggtccaatgggaagagagggttctctgagacagttgatctgaagcttaaccttcaatccaaggaagatctgaatgatgatgtgaagaatgtttcaaaggagaagaccctccttaaggaccctgccaagccaccagctaaggctcaagtagttggttggccaccagtgagatcatacaggaagaacatgatggtacagaaggtgaacaatgaggatcaaggcactgagaagacaacaagcagcactgctggtggggcatttgtcaaagtttccatggatggagcaccttaccttcgcaaggtggacttgacaatgtacaaaagctacaaagagctgtctgatgctttagccaaaatgttcagctccttcaccatgggtaactatggggcccaaggaatgatagacttcatgaatgagagcaagttgatggaccttcttaacagttctgagtatgtgccaacctatgaagataaggatggtgactggatgctcgtgggagatgtcccatgggagatgtttgttgggtcatgcaaacgcctgcgaataatgaaaggatcagaagcaattggtcttgcaccaagagccatggagaaatgcaaaaacagaagctgagctggtgtcataatacatatccaatatcagagtcctgcaccaaagtggacctataaaaaagatatatgaagtgtttgtttagtttggatgtctgtttttttttttttctttcttgttcgtatatagattcaactttaatattaaggagcctaagcctatggggacatttgtaatggacaagaagcaataaacttaacctatatact

SEQ ID NO: 394 - DNA, 1201 bp, Medicago
gaggacacacccttaaggagaaacatcatacacattttcagtttcatagagagaaaaaaaagtaaaaagagtcaatattatatcttttcaattatattctacaatcttcttattcttctaagctttgtatttcattgagaagctagccaaaaagaatatggctactatggggcatggtttgaacctgaaggagactgagctttgtctgggtctgcctggtggtggcggcggcggcggtggaggtggctctgaggtggaaactccaagggcttctggaaagagaggtttctctgagacagttgatctgaagcttaatcttcaaaccaaggaagatctgaatgagaagagtgcttcaaaggagaagaccctccttaaggaccctgctaagccaccagctaaggctcaagtagttggttggccaccagtgaggtcatacaggaagaacatgatggcacaaaaggttaacaatactgaggacactgagaagacaacaagtaacactactgctgctgcttttgttaaggtttccatggatggagcaccttaccttcgtaaggttgacttgacaatgtacaaaacctacaaagatttatctgatgccttagccaaaatgttcagctccttcaccactggtaactatggggcccaaggaatgatagacttcatgaatgagagcaagttgatggatcttcttaacagctctgagtatgtgccaacctatgaagataaggatggcgactggatgctcgtgggagatgtcccatgggagatgtttgttggatcatgcaagcgtcttcgcataatgaaaggatcagaagctattggacttgcaccaagagcaatggagaaatgcaaaaaccgaagctgaatttggtctaaatacatatcatatcctcctatatcgaagtcccgtaccaaagtggacctatatgaaaagatatatgaagcactacctgtggattggagtgttagtttggatgtgtcttcactgtttttgttttgttcgtatatagattcaaactttaattttaagtatttgtaatcgacaagaagcaataaacttaaccacctatatactattgtagtttgccttgtttaattattattattatgtgattgcttccatgctgtcatgtttgttgtgtgctatatatatattattatatactttgaattttaatgcatattttatttcctgaaa

SEQ ID NO: 395 - DNA, 1251 bp, Chickpea
ataagcatgcagccacataaacaagttccttattattgagggggctatcactttctctctcttctattctatatagccaaaaccaagcagcattataatacaagaagacacaggaaatagggaagcaaaatactataaacactttcagagtggaaaagtaaaaagagtttatataattttttgctaattaattaaggtttgagttttacattgagaagccaaaaatggctactttgattggaaaggagagtggtttgaacttgaaggagacagagctttgccttggtttgcccggtggtggtggttctggttctgaggtggaaactcaaagagctgctggaaagagaggtttttctgagacagttgatctgaagctgaatcttcaatccaacaaggaagatctgaatgacaattctaagaatgtttccaaggacaagactctccttaaggaccctgccaagccacctgctaaggcacaagtagttggttggccaccagtgaggtcatacaggaagaacatgatggcacaaaaggttaacaatagtgatcaggatggcaatgagaagacaacaagtagcactactgctggtacatttgtcaaggtttccatggatggagcaccttaccttcgtaaggttgacttgacaatgtataatacctacaaagatttatccgatgccttagccaaaatgttcagctccttcaccactggtaagtatggggcccaaggaatgatagacttcatgaatgagagcaagttgatggatcttcttaacagctctgagtatgtgccaacctatgaagataaggatggcgactggatgctcgtgggagatgtcccatgggagatgtttgttgaatcatgcaagcgcctgcgaataatgaaaggatcggaagcaattggccttgcaccaagagccatggagaaatgcaaaaaccgaagctgaagctgttctaaatcatatcctatatcaaagtcccataacaaagtggacctataagaaaagatatatgatgatcaagcacttcttcctctcatggagtgttgtgatagtttggatgtgtcatgtgtttttgttttgttcgtatatagattcaaactttaatttaaagtattttgtaatattggacaagaagcaataaacttataacctatatactatagtttgccttgtttatttatgtgattgcttccaagctgtcgtgtttgttgtgtgctaaaatatatacacttttgaattttaatgcata

SEQ ID NO: 396 - DNA, 1255 bp, Peanut
gggactgcttccaatttctatatagccaaaccaagaaagcattataatagaaagaagagaacaccatattcataagaaacagtttgagagagcaaagagaaagagaaagagaaattagaattagaaaataagctgagagagttccatttgataacggtagagccaaaaatggcaactatgttggcaaaggagcatggcttgaatctgaaagagactgagctttgccttggcctgcccggcggaggtggaggcggaggcggagacacggcaacggcagaaactccgagagccaccgggaagagagggttctctgagacggttgatctgaagcttaaccttcaaggcaatgatactaacaaggaagatctgaatgagaatctgaagaatgttccaaaggagaagactctccttaaggaccctgccaagccacccgctaaagctcaagtagttggatggccaccagtgaggtcatacagaaagaacatgatggcacaaaaagtgagcactgaggaaaataacaatggcagcgccaccactgagaagacaacaagcagcgccgccgctgcagccaccaccgcagcttctactggtggttcatttgtgaaggtctccatggatggagctccttaccttcgcaaggtcgacctgacaatgtacaaaagctaccaagacttatctgatgccttggccaaaatgttcagctccttcaccatgggtaactatgggtcccaaggaatgattgatttcatgaatgagagcaagttgatggatcttctgaacagctctgagtatgtgccaacctatgaagataaggatggtgactggatgctcgtgggtgatgtcccatgggagatgtttgttggatcatgcaagcgtctgcgaataatgaaaggatcagaagctattgggcttgcgccaagggccatggagaaatgcaaaagcagaagctgaagctgaagctgctggtccaatacatgttctatatatatatgatcagaatccgtaccaaagtttaccctataaaaatatatatgaatccaccatagcacttctgctgctgggacatatgtttttatttacttattgttagtttggcatgtgtctgtgttttttgtattattattgttggtatatagattcaacttttaattttaaggagcctgtgatggtgatgatgatgggggcatttgtaatggaacaagaagcaataaacttaacctataatactagtctggcttgtttattattattgtta

SEQ ID NO: 397 - DNA, 1650 bp, Cacao
aaacataatagcgaaagaaaccagacagaagaagcagaggcaaaagctatatatcaagaaaacacaagagagagagagagagagagagagagataggagcaaaagaaaggaataagaaaaggtcaagagattattttttccatggaagttagtcgcaaaatggccaacatgcttggtgctgagcgtgatttgaacttcaaagagactgagctgtgtcttggattgcctggtggaggtggaggtggaggaggtggtggcggaaatgaagtggaaactccaaagactactgggaaaagaggcttctctgagactgttgatttgaagctgaatcttcagtctaaggaaactggcatggatctgaacaagaacatagagaatggttcaaaagaaaaaactctcctccctgcttgcaccaaagatcctgcaaaaccaccagccaaggcacaagttgtgggttggccgccagttcgatcttacaggaagaacattatggctaaccagaaaaacagctgtgaggaaagtgataagaaagctagcagtggtggtgcagcgtttgtgaaggtttccatggatggtgccccatatctgcgaaaggtagatttgaagatgtacaagagctaccaagagttatctgatgccttggctaagatgttcagttccttcactatgggtaactatggagctcaaggaatgatagacttcatgaatgagagcaagttgatggatcttctcaacagttccgattatgtgccaacctatgaagataaggatggtgactggatgctcgtgggggatgtcccatgggagatgtttgttgactcatgcaagcgcttgcgcataatgaaaggatcagaagcaattgggcttgctccaagagcaatggagaaatgcaagagcagagcctaaaccatacacctagcgtttggccagctgctggttctttccaagttctgtatccctaaagcctggattgctgcaacaagatcctggaacagagcaaggctagctggctgcacctttggatgtgtctgtatttttatttgatatttggtatatagatatgcaaaaagatctgggacatttgtaatggacaagaagcaataaacttaaccctattgtctggcttgtttattgctaatggggcttgtttaataatcacctgtttttgctattgtctggtcgtccttgctgtcatagttgttgtgtatgtgttttattcctttccccccagttttaatgctaatacctttttctttccctctacctccaatcaaaaagattcttcatatcatgtaattccatattcttcatttattaatttaattatttgcattgttatattactattgttttatatatatatatatattctagtgtataatggagtaccttgaaatttgttagaatttcaggacccccatgagggaaggggggaacaaggccatgtgcaggctgatggggggcattcattcatgaccattagtttatgctgtttactggttatcagtgtttttttttaaattttgggagggggagaagtgtgggggagataatcaaaaacataacaacttgactggtgaatgtaaggctgctggctgaatgtggctgaattttataaaagtagagacggtggtttgtagcagcacttgc

SEQ ID NO: 398 - DNA, 1171 bp, Clover
gagaaactacaagcacttttagtttcatagagaaaggaaaagtaaaaaagagtgtttattatttcttttcaaagaaatatttctgctgaggtttggatttcattgagaagccaaaaatggctactatgattgggaaagataatgatttgagcttgaagactgagctttgtcttggtttgcctggtggtggtggcggtggcggctctgagcaggttgaaactccaagggcttctgcaaagagggggttctctgagactattgatctgaagctcaatcttcaaaccaaagaagatctgaatgggaatatcaagaatgcttcaaaggacaagagcctccttaaggacccttctaagccaccagctaaggctcaagtagttggttggccaccagtgaggtcatacaggaagaacatgatggcacaaaaggttaacaatattagtgaagatggcaataatgagaagacaacaagcagcactacttctggtgcatttgttaaggtttctatggatggggcaccttaccttcgtaaggttgacttaacaatgtacaaaacctacaaagatttatctgatgccttagccaaaatgttcagctcctttaccactggtaactatggggcccaaggaatgatagacttcatgaatgagagcaagttgatggatcttcttaacagctctgagtatgtgccaacctatgaagataaggatggagactggatgctcgtgggagatgtcccttgggagatgtttgttggatcatgcaagcgtcttcgcataatgaaaggatcagaagcaattgggcttgcaccaagagcaatggagaaatgcaaaaaccgaagctgaatttggtctaaatgcatatcctatatatatcaaagtcccataccaaagtggacctataagaaaagatatatgaaagctagcactacctttggattggagtgtttttagtttggatgtgtcttaagtgttttttgttttgttcgtatatagattcaacttttaattttaagtatttgtaatcaacaagaagcaataaacttaaccacctatatacactattattatagtttgccttgtttaattattactactattatgtgattgcttccttggtgtcatgtttgttgtgtgcaatatgcctatataatatactttgaattttattaaaa

SEQ ID NO: 399 - DNA, 2403 bp, Soybean
ctctcgtctcacttgaaactccacaacccaattttcttttcctatgacccaattccaaatccaaatcaccaattctaattccattcttcaggagttgaattgaattcgtgatgaagagggaccacaaagatagctgcggcggcggcggcgccgccggagggactgtgaagggtgagtgttcctcaatgcagtcaaacgggaaggcgaagatgtgggaggaagagcaacagcagcagcagcagcaacaacagcaacaacaacaacaggggatggacgagttgctggcggcgttggggtacaaggttcgtgcttccgacatggctgacgtggcacagaagctggagcagttggagatggtcatgggttgtgcccaggaagacggaatttcccacctggcctccgacaccgttcattacgaccctacagatctctattcctgggtccaaagcatgttaaccgaactcaaccccgaacccaacaacaacctcgatccatcttctttcttgatcgacaacaacaacaacatcatcaacagcacagcccctgttttcaacgacgattccgaatatgacctcagagccattcctggcatagcagcctaccctcctcctcttcctcaagacaaccacctcgacgaaatcgaaacggctaacaacatcaacaagcgcctcaagccatctccagcggaatcagcagactccgccgcgtctgagcccacgcgccatgtcgtcctcgttgaccatcaggaagccggcgtgcgtctcgtccacactctcctggcgtgcgcggaggccgttcagcaggagaatctcaagctcgcggacgcgctcgtcaagcacgtgggcatactcgcggcttcccaagccggcgccatgaggaaggttgcttcctacttcgcccaagccctggcgcgtagaatctacggaatcttccccgaagaaaccctcgattcctccttctccgacgttctccacatgcacttttacgagtcttgcccttatctcaaattcgcgcacttcaccgcgaatcaggccatcctcgaagccttcgccaccgccgggaaagtccacgtcatcgatttcggcctcaaacaagggatgcagtggccggcactcatgcaggccctcgcattacggcccggcgggcccccgactttccgtttaaccggaatcgggcccccacagcccgacaacaccgacgcgctgcagcaggtgggcttgaaattagcccaattggcccaaatcatcggcgtccagttcgaattccgcggcttcgtttgcaacagcctcgcggatctcgacccgaatatgctcgagatccgacccggggaagccgtggcggtgaattccgtcttcgaactccaccgcatgctcgcccggtccggatccgtcgacaaggtcttggacactgtcaagaaaattaatccccagatcgttaccatcgtggaacaagaagcgaaccacaacggaccgggttttctagaccggttcactgaagccttgcattactattccagtcttttcgactcgcttgagggttcgtcttcttcttcgaccgggttgggctcgccgagtcaggatctgttgatgtccgagttgtaccttgggagacagatttgcaacgtggtggcttacgagggcccggaccgggtcgagcggcacgagactttgactcagtggagggggagattggactcggccgggttcgacccggttcatctcgggtccaacgcattcaagcaagcgagtatgctacttgctctattcgcaggcggtgatgggtatagggttgaggagaataacggctgcctcatgcttggctggcacactaggccactcatcgctacctccgcttggaagcttccctcctccagcgagtctagtggcttgactcagtgaatgtaaaactatagattaattggacttgttccagtgaactgagtcagtgaccgagtcagtgagccttccaggcagcaagaggataaataaatgagagggtgaacaaaaaaaaaaaaaaaagtaaaaagaaaacccaaagaaagactgtaatttgtaattgtgctctcataattaccgtttctcctctttagtgttttgttttcctttctctaaattattattattatataatttgtttaattcttcagtattatgatgtccttttcgttttaatctttatctttataatgtgttgttgtgacttctgagattgattaacttgaattaactctttcacttttgttggagggggagggagtggtccatgcgaggatattgattgtgtcgatctttttaatcttttgttgtctgattttttaataaatgaatcaaagaggtgttgtaattttagtcttgtctagcttttaagttgtttcttttcatgaataaaaaccttgcatcgcgg

SEQ ID NO: 400 - DNA, 2360 bp, Pigeonpea
ttatcttttttcaatttccacccttctctctctctcttgactctctatgctcccaattcaagcgaatttcattggtgaggtgctgaattagtgattagtgatgaagagggatcacgaagacaggggtggggtgagttcgtcaatgtcgaactcgagcgggaaggcgaagatgtgggaggaggagcagcaacagggggggaatgacgagttgctggcggcgttggggtacaaggtgcgttcctcggacatggctgacgtggcgcagaagctggagcagttggagatggtgatggggagtgctcaggaagagggaatttctcacctggcttccgacaccgttcactacgaccccaccgatctctattcctgggtccaaaccatgctcaccgaactcaaccctccccctaacaacctcgaccacctcttaatccaagaccccatcctcaccccctcacgcgttttcaatgacgactccgagtacgacctcagagccattcccggcatcgccgcataccctcctcaaaacaccaacaacaacatcgaagaaatcgaggccaacaaccacaacaataacaacaacaagcgactgaaaccttctccaattgaatccacagattcagtctcggagccgacgcggccggtggtgctggttgactcgcaggaaaccggcgtgcgtcttgtccacacactgatggcatgcgcggaggccgttcagcagaagaatctgaagctggcggaggcgctggtgaagcacgtggggatactggcggcgtctcaagccggagccatgaggaaagtggctttctacttcgctcaggccctagcccatcgaatctacggcgccttcccggaggagcctctcgactcttccttctcggatcttctccacatgcacttctacgagtcctgcccctatctcaaattcgcgcacttcaccgccaaccaggccattctggaagccttcgccaccgcagggagagtccacgtcatcgacttcggccttaagcaagggatgcagtggcccgccctcatgcaggcactcgcattgcggcccggcggcccccccaccttccgcttgacaggaatcggcccgccccagcccgataacaccgacgcgctgcagcaggtgggcttgaagctggcccagctcgccgagacaatcggcgtgcgattcgagttccgcggattcgtttgcaacagcctcgccgatctcgacccgaacatgctcgagatccgacccggggaagccgtcgcagtcaattccgtctttgaactccaccgcatgctggcccgacccggatccgtggagaaagtcctggacactgttaagaaaatcaagcccaaaatcatcaccgtagtggaacaagaagccaaccacaacgggccggtttttctcgaccggttcacggaggctttacattattactcgagtttattcgactcgctggagggttcctcctcctcgaccgggttgggctcaccgagtcaggaccacttaatgtcggaggtctacctcgggagacagatatgcaacgtggtggcttacgagggcgtggaccgggtggagcgccacgagactcttacccagtggagagggagattgggctcgggcgggttcgacccggtccatctcggttccaacgcgttcaagcaagcgagtacgctgctggctctattcgcgggcggtgatgggtacagggtggaggaaaataacggctgcctcttgctagggtggcatactaggccactcatcgccacctccgcgtggaagcttccctcgagcgagtcctagtgggttcactcagtgggtcccccgagttaattggactgtacactgtagactaattggatcgtgggagtgggaatggaatggtaaatgggtaaatgggtaaagtggtaaaaaatgatgcttgattgaacttgttggagtggagtgagtaagagtgagccagcgtggcaggaggtataaataaagtgagagggggaaaaatagaagaaaaaaaaaaaagaagactgtaatttgtaattgtactcctcgtaattacttttctctctttagtgtttttctttctctaaattattattattattattatattatataatttgtttaatttttaatttggatgtctattaatcttgatgcgtgtgagacgagactagattaacttgaattaactcgtttaccgtgtgtcgtgatgttgttggttcaatggttctggccagagagagggtggtccaggcgaggaaattgattgtgtagcttttcttgtctgggtttttaataaattgaatgaggtgttgtaattctagtcgtgtcaagcttttaataaattgtttctttttggtgaatgggagct

SEQ ID NO: 401 - DNA, 2551 bp, Bean
tattatggcttccattctcccttatctttttcaacctccacccttctctctctccctttccacctctctcacttccaactcctcaccccccttttcctatgacccaattccatttccaaatcaccaatcctaatttcaattccattcatcccctcctcctcctccattcaattattcccatcacgcttcctacttcttccccatgaagagggatttccaacaagcctgcgccggaggccctgtcaagggtgactcttcctcaatgcccaacggcaaggccaagatgtgggaggaagaccgccaccagcagggaggaggcatggatgagttgctcgcggccttgggttacaaggtccgtgcttccgacatggcagacgtcgctcagaagcttgagcagctcgagatggtcatggggagtgcccaggaagagggaatttcccacctttcttcctacaccgttcactacgaccctacggatctccattcttgggtccagagcatgttatctgaactcaaccccgaacccaccaccatcctcgatccctcatccttcttgatcgacaaccccgtccactcttcccccatcctcaccaccacctcacgcgttttcaacgacgactccgaatatgacctcagagccattcctggaatagccgcatatcctcctcaacacgccacaaacaacgccaccaccattagcactaccactgccaccagccccactaccaccgtcgccaccaccaacacccaaactgtggaagaaatcgaaccaggtaccaacaagcgcttgaaggcttccccaattgaatcctcggagtccgcttcggagcccacccgccccgtagttctcgttgactcacaggaagccggcgtgcgtctggtgcacactctcatggcttgcgctgaggccgtccaacaggagaatctgaagctggcagacgcgctggtaaagcacgtgggcatactggcagcgtcgcaagccggcgccatgaggaaagtggcgacgtacttcgcccaggcccttgcgcgtcgaatctacggcatcttcccggaggaaactcttgattcctctctctccgaccttctacacatgcacttctacgagtcctgcccctatctgaagttcgctcacttcactgccaaccaggccattctggaggccttcgccaccgctgggagagtccacgtcatcgatttcggcctcaagcaagggatgcagtggccagccctcatgcaggccctcgcattgcgcccaggcggtcctccaaccttccgcctaaccggaatcgggcccccgcagcccgacaacactgacgcgctgcagcaagtgggctggaagcttgcccagttagcccaaaccatcggcgtccagttcgaattccgcggattcgtctgcagcagcctcgcagatctcgacccgaacatgctcgagatccgtcccggagaagccgtagctgtcaactccgtcttcgagctccatcgcatgctcgctcgacccggatccgtcgacaaggtcatggacacagttaaaaacctcaaccccaaaatcgtaaccatcgtggagcaagaggcgaaccacaacgggccggttttcttggaccggttcactgaagccttgcattactactcgagtctgtttgactcgctggagggttcttcctcctccaccgggttaggttcgccgagtcaggatctgttgatgtcggaggtgtaccttgggaaacagatatgcaacgtggtggcgtacgaaggcgtggagcgcgtggagcgtcacgagactctgagccagtggagggggcgaatgggctcggcagggttcgacccggttcatctcgggtcaaacgcattcaagcaagctagtatgttgctggcgctattcgccggcggtgacgggtacagagtggaggagaacaacgggtgcctcatgcttgggtggcacactaggcctctcatcgccacctctgcgtggaagcttccctcgcccgagtcctaatgggttcactcgctgagttccccgagttaaccagctgtactgtacactgtagattaattggatcgtggtcgtggatgatgatgatcatggtaaatcggtaaaaatggtttgatgaagttgttggagtggagtgagtcagtgaccgagtcaggcagcgaggcagaaggaggataaataaagtgagaggaaaaaaaacctaaaagaaaagaaaaaaaaagaagactgtaatttgtaattgtactcctaattaccgtttctcttttagtgttttgatttcctttctctatattattattattattattactattatataatttgtttaattcttccaagttggatgcttttccttggtttttaatctttatcttgatgtgtgggattaacttattatagtattaacggacgttgttggagggagtggtcctgctcgagaattcactgtgctacttttttttgttgtttcggtttttaataaatgaaagaggtcttgtaattttactcctgtcaaccttttttaataacttctttcttctcatcaataaaatccttacattt

SEQ ID NO: 402 - DNA, 3522 bp, Soybean
tgttatctttatatttcttctctgtggtggggcagcttccttctcaggacattttagcattgctggagtttaagaaaggcatcaagcatgaccctactggttatgttctcaattcctggaatgaggaatccattgactttgatggatgcccatcttcatggaatggagttctgtgcaatgctggcaatgttgctggggttgtccttgataacttgggtctctctgctgaccctgacctgagtgtgttttcaaatcttacaaagcttttacggagcttgcagaatctgtcattggctggaaataacttctccggcccaattcctgactctatttcagaaatggcctccatcaagtccctggacttgagccgcaactccttctctggaatgctgccagtgacgttgactaagacgactagtcttgtatctcttaacttgtctcataatggcttcactggaaaagttcccaaaggttttgagctgatccccgctcttgaaaaacttgacttgcatggaaatatgcttgaaggtaatttggatgttgtatttatgcttttatcaagtgccagctatgttgatttaagtgagaacatgctgtcaagttctgattccaagaagaagtttctaccacgaatatctgaaagtattaagcatctgaatctaagccacaacaagcttactgggtcattggctagtggagctgctgaacctgtttttgaaaacttgaaggtgttggacctcagctacaatcagttggatggagaattgcctggatttgattttgtttatgatcttgaagttcttagacttagcaacaacagattttcaggatttattcctaatggcctgctgaaaggagactctttggttttaactgaattggatttgagtgccaacaacctctcagggccactaagtataattacatcaacaacacttcattctcttaatctctcatcaaatgagttcacgggtgatctgccgctgctgactggaagctgtgctgtacttgatctgtcaaacaacaaattagaaggaaacttgaccaggatgttgaaatgggggaatatagaatttcttgatctcagtgggaatcatttgacggggaccatccctgaggaaactcctcaatttttgcgattgagttatttgaacctatcccataattctctaagcagctcccttccaaaagtcttaacacagtatccaaagcttagagtgctcgacattagtttcaaccaattggatggactacttctagctaatctgctcacactgtccacattgcaagagctgcaccttgaaaataatatgatctctggtggcatcaagttttcatcttctgctgaccaatctgatcttcagattcttgatctttctcacaaccagcttaatggctattttcctgatgagtttgggtcattaactggcctgaaagtgctaaatattgctggaaataatttttctggttctcttccaactaccattgctgacatgagttcactagactccctggatatatcagagaatcattttgctggtcctctaccaagtaacatcccaaaggggctccaaaactttaatgcttcacaaaatgatctgtcaggacttgtcccggaagttcttagaaagtttcctagttcttctttctttcctgggaataccaagttacattttccaaatggtcctcctggatcagtcagttcacctgctaaaagttccaagaggaagcatatgaacaccatagttaaagtcataatcatagtgtcatgcgtggttgcactcttcatattaatcttgcttgctgtcttcatacactacatacgtatatcaagatctccacaagaatatgatgcaagtaaggatatccacaggcatcctcaaccaattatctcggctcctgttcgtacgactgataggggtggtgctttggttgtttcagctgaggaccttgtgacctcacgcaaagagtcaccatcggagattatcagctctgacgaaaaaatggcagctgtaacggggttctctccatcaaaacaaagccacttttcatggtcaccagaatctggtgattcacttactggtgaaaatcttgcaagactagatacgagatcgccagatcggttgattggtgagctgcattttctggatgatacgataacattgacacctgaggagctctcaagggccccagctgaagttttgggaagaagtagtcatggtacttcttacaaggcaactctggagaatggtttgttgttgagagtgaagtggttgagagaaggagtggcaaaacagagaaaagaatttgtcaaggagatgaagaaatttgcaaacatcagacatccaaatgttgtaggattgagaggatattattggggtcctacacagcatgaaaagcttatactttcagattacatctcacccggaagtcttgctagttttctttatgatcgaccaggaagaaaaggtccaccactaacttgggcccagaggctcaaaatagcagtcgatgtagcacgtggtctgaactatctccattttgatcgtgctgttcctcacgggaatctcaaagctacaaatgtgttgttagatacaactgatatgaatgcacgtgtcgccgattactgccttcaccgactcatgactcgagctggtaacattgaacagattcttgatgctggggtcttgggttatcgtgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagattgggtaaggttgcgcgtagcagaaggccgaggctcagaatgttttgatgctaccttgatgccagaaatgagcaatccaattgcagaaaagggaatgaaggaggtcctgggaatagtgatgcggtgcattcggtctgtttctgaaaggcctggtatcaagactatttatgaagatctctcttctatataatctgctcatgctaactgtttcaactttgacatattgtgggaattaatgtctcattagtgtcccatgttggttcagagcttggccttttaacatgtttgtattaaccatttttttagctgtaaaaatggggctgcgccaaaagcatatacatggatgttacttgatgggttgtgaccatctaattctgtcttgaaatggtatgtgctatgaatggtcatttctttgcaagtactacacggttgaaggctgtacaagttggtcatgtaaccgttagcacttagcagttatatttttttgttgatttaattgatcttttttagagttgatggccaaagatgttggacatagttctccgcaaactcagctggttttcactttcaggaagttgcgtgccactaatgagtaacagtagctgttactattgtcatgtaatcacaatggttgtggaagccatgatttattaaattcaatctttgcctgtgttgat

SEQ ID NO: 403 - DNA, 3500 bp, Bean
agactatgaagctatttagccttttagtgttatctttgtattttttctccgtggtggggcagcttccttctcaggacattttagcattgctggagtttaagaaaggagtcaagcatgaccccagcggctatgtgctcaattcctggaatgaggaatccattgattttgatggatgcccatcttcatggaatggagttttgtgcaatggtggtaatgttgctggggttgtccttgataacttgggtctctctgctgacacagacttgagtatgttttcaaatctcactaagcttgtaaaactctccatggccaacaattccataacaggaagtctacatggcagcattgctgagttcaaaagccttgagttcctggatatttccaataacctcttttcctcatctttgccactgaatattggtaaattaagcagtctgcaaaatctgtctttagctggaaacaatttctctggtccaattcccgactctatttcagaaatggcttccatcaagtccctggatttgagccgcaactctttctctggagaactgccagtgttgttgacaaaggtgactagccttgtatctcttaacttgtctcataatggcttcactggaaaaattcccaaaggttttgagatgattactgttcttgaaaaacttgacttgcatgggaatatgcttgaaggtaatttggatgttgaatttttgcttttatcgagtgccagctatgttgatttaagtgagaacaggctgtctagttctgattccaagcagaagtttctaccacgactatctgaaagtattaagcatctgaatttaagtcacaaccagcttacgggatcattggccagtggagttgcagaacctgtttttgaaaacttgaaagtgttagacctcagctacaatcagttggatggagaattgcctggatttgattttgtttatgatctccaggtcctccggcttagcaacaacatgttttcaggatttattccgaatggcctattgaaaggagactctttggttttaactgaactggatttgagtgccaacaatctctcgggaccactaagtataattacatcaacaacacttcactctcttaacctctcatcaaatcagttcactggtgaactgccaccccttacgggaagctgtgctgtacttgatctgtcaaccaacaaattagaaggaaatttaaccaggatgttgaaatgggggaatatagaatttcttgacctcagtggtaatcatttgatggggaccattccagaggaaactcctcaatttttgcgactaaattatttgaatctatcccataattctcttagtagctcccttccaaaagtcttgactcagtatccaaagctgagagtgcttgacattagtttcaaccaactagatggaccacttctatctggtctactcacaatgtccacattgcgagagctgcatcttgaaaataatgtgatctctggtggcatcaatttctcatctcctgaccaatctgatcttcagattcttgatctttctcacaaccagcttaatggctattttcctgataagtttgggtcattaactggccttaaagtgctaaatattgctggaaataatttttctggctctcttccaaccaccattgctgacatgaattcacttgactccatggatatatcagagaatcattttactggacctctaccagataacatgccacaggggctccaaaatttcaatgcttctgaaaatgatctatctggactcgtccctgaagttcttaggaagttccctagttcttctttctttcctgggaattccaagttacattttccaaatggtcctccaggatcaactgcttcacctgctgaaagttccaagaggaagcatttgaacaccattgttaaagtaataatcatagtgtcatgtgtggttgctctcttcattttaatcctgcttgcagtcttcatacactatatacgtatatcaagatctccaccagaatatgatacaagtaaggatatccacaggcatcctcaacctattatctcggctcctgttcgaactactgataggggtggtgctttggttgtttcagccgaggaccttgtgaccacacgtaaagagtcgccatcagaggtaataagctctgatgaaaaaattgcagctgtaacagggttctctccatcaaaacaaagccacttttcatggtcaccggaatctggcgattcattcactggtgaaaatcttgcaagactagatacaaggtcaccagatcggttgattggagagctgcattttcttgatgattcgataacattgacacctgaggagctctcaagggccccagctgaagttttgggaagaagtagtcatggtacttcttataaggccactttggagaatggtttgttgttgagagtgaagtggttgagagaaggagtagcaaaacagagaaaagaatttgtcaaggaaaccaaaaaatttgctaacatcagacatccaaatgttgtgggattgagaggatactattggggccctacacagcacgagaagctcatcctttcagattacatctctccgggaagtcttgcaagctttctttatgatcgaccaggaagaaaaggtccaccattaacttggatccagagactcaaaatagcagttgatgtagcacgtggcctgaactatctccattttgatcgtgccatccctcatgggaacctcaaagccacaaatgtgttgttagacacaactgatatgaatgcacgagttgctgattactgccttcaccggctcatgactcaagcaggtactattgagcagattcttgatgctggggtcttaggttatcgagcacctgagttagcttcctccaagaagccaatgccctccttcaagtcagacgtttatgcttttggagtgatacttttggaacttctaactggaaggtgtgctggtgatgtgatatctagtgaggagggaggtgttgatctgacagattgggtgagggtgcgtgtggcagaaggcagaggctcagaatgttttgatgctaccttgatgccagaaatgagcaatcctattgttgaaaagggaatgaaggaggtcctgggaatagccatgcgatgcattcgatcagtttctgaaaggcctggcatcaaaactatatatgaagatctctcttctatatagtctgctcatgctaactgtttcaactttggcatgttgtggggattaatgtctcattagtgtcccatatttgttcaaagcttggccttttaacatgtttgtattaaccattttttagttgtaaaaatggggcatgtgccaaatgcatatacatggattttacttgatggttgtaccatctaattttgtcttgaaatggtttgtgttatcaatcatcatttgtcttgaaatggttaattctgtgtagttagtttgtacaaacgattcacattttagttgattgccaaagatgttggcatagttctcagcaaa

SEQ ID NO: 404 - DNA, 3739 bp, Pigeonpea
ggggcagcttccatcccaggacattctagcgttgctggagtttaagaaaggcataaagcatgaccctactggttatgttctcaattcatggaatgaggaatccattgactttgatggatgtccatcttcatggaatggagttctgtgcaatggtggtaatgttgctggggttgtccttgataacttggggctctctgctgacactgacttgagtgttttttcaaatctcacaaagcttgtgaaactctccatggccaacaattccatatctggaaaattgcctgacaacattgctgatttcaaaagccttgagttcctggatatttcgaataacctcttttcctcatccttgccattgggaattggcaagttaggtagcttgcagaatctttcattggctggaaacaacttctccggcccaattcctgattctatttcacaaatggcttccatcaagtccctcgatttgagtcgcaactccttttctggagccctgccagcatcattgactgaggtgaatagccttgtgtctcttaacttgtctcataatggcttcactgggaaaattcccaaaggttttgagctcatccctgctcttgaaaaacttgacttgcatgggaatatgcttgaaggtaatttggatgttgaatttatgcttttatcaagtgccagctatgttgatttaagtgagaacatgctgtcaagttctgattccaagcagaagtttcttccgcgactatctgaaagtattaagcatctgaatctaagccataaccaacttactgggtcattggcaagtggagctactgaacctgtttttgaaaacttgaaggtgttggacctcagctacaatcagttggatggagaattgcctggatttgattttgtttatgatctcgaggtccttaggcttagcaacaacagattttcaggatttattcctaccggcctactgaaaggggactctttggttttaaccgaattggatttgagtgccaacaatctcacggggtcacttagtataattatatcaacaacacttcgctctcttaatctctcgtcaaatgagttcactggtgaactgccactgctgactgggacctgtgctgtacttgatctgtcaaataacaagttagaaggaaacttaaccaggatattgaaatgggggaatatagaatttcttgatctgagcgggaatcatttgacaggggccatccctgaggtaactcctcaatttttacgattaaattatttgaatctttcccataattctcttaccagctcccttccaaaagtcataacacagtatccaaagcttagagtgcttgacattagtttcaaccaattagatggattacttcgagctggtctgctcacaatgcccacaatgcaagaactgcatctcgaaaacaatatgatctctggtggcatcaatttatcatcttctcttggccaatctgatcttcagattcttgatctttctcacaaccagctcaatggctattttcctgatgagtttgggtcattgactggcctgaaagtgctaaatattgctgggaataatttttctggttctcttccaaccaccattgctgacatgagttcactggattccatagatatatcagagaatcattttactggtcctctaccaaataacatgccaaaggggatccagagctttaatgcttcacaaaatgatctgtctggagtggtcccagaagttcttagaaagtttcctagttcttctttctttcctgggaataccaagttacattttccaaatggtcctcctggatcaacctcttcacctgcggaaagttccaagaggaggcatatgaacaccattgttaaagtaataattatagtatcatgtgtggttgcactcttcatattaatcttgcttgctgtcttcatacactatattcgtatatcaagatctccaccagaatatgatacaggtaaggatgttcacaggcgtcctcaaccaattatctcagctcctgttcggacgacagataggggtggtgctttggttgtttcaacggaagaccttgtaacatcacacaaagagtcaccatcagagatagtcacccctgacgaaaaaatggcagctgtaacggggttctctccatctaaacaaagccacttttcatggtctccagaatctggtgattcatttactggtgaaaatcttgcaagactagatacaagatcaccagaccggttaattggagagctacattttctcgatgatacaataacattgacaccggaggagctctcaagggcaccagctgaagttttgggaagaagtagtcatggtacttcttacaaagcaactcttgataatggcttgttgttgagggtgaagtggttgagagaaggagtggcgaaacagagaaaagaatttgtaaaggagacaaaaaagtttgcgaacatcaggcatccaaatgttgtgggattgagaggatattattggggtcctacgcagcacgagaagcttatactttcagattacatctcaccaggaagtcttgcaagttttctttacgatcgacctggaagaaaaggtccacctttaacttggtctcagaggctcaaaatagccgttgatgtagcacgtggcctgaactatctccattttgatcgtgccattcctcacgggaacctgaaagctacgaatgtgttgttagatacaactgatatgaacgcacgtgttgctgattactgccttcatcggctcatgactcaagctggcactattgagcagattctggatgctggtgtcttgggatatcgggcaccggagttggctgcttccaagaagccaatgccctctttcaagtcagatgtttatgcttttggagtgatacttttggagcttctaacaggaaggtgtgctggtgatgtgatatctagcgaggagggaggtgttgatttgacagattgggtgcggttgcgtgtagcagaaggccgaggctcagaatgttttgatgctgcattgatgtcagaaacgggcaatgcagttgtggaaaagggaatgaaggaggtcctggggatagcaatgcgatgcattcgatcggtttctgaaaggcctggtatcaagactatatatgaagatctctcttctatatagtttgctcatgctaactgtttgaactttgacatattgtgggaattaatgtctcattagtgccccatgcttgttcagagcttggcctctttaacatgtttgtattaaccatttttttagctgtaaaaatggggccatgtcaaaagcatatacatggatgttacttatggccatctaattttgtcttgaaatggtatgagttatgaacgatcaattgtttgcaggttggccatataatcgttggttagcacttagcagttgtatttttggttgatttaattgatcttgtagttgaaggccaaagatgttggacagagtcctcagcaaactcagctggttttcactttaaggaagctgagtgccaccaatgtgacagtagcatgatactgtacagtgcagctgttagtattgtgatgtaatcactgtggttgtggaattatctcgagatataattcttttttgttcaattcaaaagattttcaagcatgttagatttgatgttatattataaacatgttcttaaatctgtcaaataagcacagtcgttttagattatttgtatagaaaaaattgaattttattaaatgtgaatctgaaagaaaa

SEQ ID NO: 405 - DNA, 3393 bp, Soybean
ggcagcttccctctcaggacattttaacattgctggagtttaagaaaggcatcaagcatgaccctactggttatgttctcaattcctggaatgaggaatccattgactttgatggatgcccatcttcatggaatggagttctgtgcaatggtggtaatgttgctggggttgttcttgacaacttgggtctctctgctgacactgacttgagtgtgtttactaatctcacaaagcttgtgaaactctccttgtccaacaattccatatcaggaacactacttgacagcattgctgatttcaaaagccttgaattcttggatatctcttataacctcttttcctcatccttgccattggggattggtaaattagggagcttgcagaatctgtcgttggctggaaataacttctctggcccaattcctgactctatttcagaaatggcctccatcaagtcccttgacttgagctgcaatgccttctctggaatgctgccagcatcgttgactaagactattagtcttgtatctcttaacttgtctcataacggcttcaatggaaaaattcccaaaggtttggagctgatccctgctcttgaaaaacttgacttgcatgggaatatgcttgaaggtaatttggatgttgtatttatgctttcatcaagtgccagctatgttgatttaagtgagaatatgctgtcaagttctgattccaatcagaagtttctaccgcgaatatctgaaagtattaagcatctgaatctaagccacaacaagcttactgggtcattggctagtggagccgcggaacctgtttttgaaaacttgaaggtgttggacctcagctacaatcagttggacggagaattgcccggatttgattttgtttatgatcttgaagttcttaaactcagcaacaacagattttcaggatttattcctaatggcctgctgaaaggagactctttggttttaactgaattggatttgagtgccaacaatctctcagggccactaagtataattacatcaacaacacttcattctcttaatctctcatcaaatgagttcacgggtgatatgccactgttgactggaagctgtgctgtacttgatctgtcaaataacaaattagaaggaaacttgaccaggatgttgaaatgggggaatatagaatttcttgatctcagtcggaatcatttgacgggggccatccctgaggaaactcctcaatttctgcgattgaattatttgaacctatcccataattctctaagcagctcccttccaaaagtcttaacacagtatccaaagcttagagtgctcgacattagtttcaaccaattggatggactacttccagctaatctgctcacactgcccacattgcaagagctgcgtcttgaaaataatatgatctctggtggcatcaagttttcgtcttctcctgaccaatccgatcttcagattcttgatctttctcacaaccagcttaatggctattttcctgatgagtttgggtcattaactggcctaaaagtgctaaatattgccggaaataatttttctggttctcttccaactaccattgcagacatgagttcacttgactccctggatatatcagagaatcattttactggtcctctaccaagtaacatgccaaaggggctccaaaactttaatgcttcacaaaatgatctgtctggagttgtcccagaagttcttagaaagtttcccagttcttctttctttcctgggaataccaagttacattttccaaatggtcctcctggatcaatcagttcacctgctgaaagttccaagaggaagcatatgaacaccatagttaaagtcataatcatagtgtcatgcgtggttgcgctcttcatattaatcttgcttgctgtcttcatacactacatacggttctctccatcaaaacaaagccacttttcatggtcaccagaatctggtgattcacttagtggtgaaaatcttgcaagactagatacgagatcgccagatcggttggttggcgagctacattttcttgatgatacgataacattgacgcctgaggagctctcaagggcccctgctgaagttttaggaagaagtagtcacggtacttcttacaaggcaactctggagaatggtttgttgttgagagtgaagtggttgagagaaggagtggcaaaacagagaaaagaatttgtaaaggagacgaagaaatttgcaaacatcagacatccaaatgttgtaggattgagaggatattattggggtcctacacagcacgagaagcttatactttcagattacatctcactaggaagtcttgcaagttttctttatggaagaaaaggtccaccactaacttggacccagaggctcaaaatagcagttgatgtagcacgtggcctgaactatctccattttgatcgcgctgttcctcacgggaatctcaaagctacaaatgtgttgttagatacaactgatatgaatgcacgtgttgccgattactgccttcaccgactcatgactcaagctggtaccattgaacagattctcgatgctggggtcttgggttattgcgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagactgggtaaggttgcgtgtagcagaaggccgaggctcagaatgttttgaggctaccttgatgccggaaatgagcaatccagttgtagaaaagggaatgaaggaggtcctgggaatagcaatgcggtgcattcggtccatttctgaaaggcctggtatcaagactatttatgaagatctctcttctatatagtctgctcatgctaactgtttgaactttgacatattgtgggaattaatgtctcattagtgtcccatagttgttcagagcctggccttttaacatgtttgtattaaccatttttttagctgtaaaaatggggctgtgccaaaagcatatacatggatgatggatgttacttgatgggttataaccatctaattttgtctcgaaatggtatgtgttatgaatagtcatttgtttgccagtactatagttgaaggctgtccaagttggtcatgtaatggttaacacttagcagttatattgttttgttggtttaattgatcttagagttgaattgccaaagatgttagagacgtagttctcagcaaactcggctggttttcactttcaggaaggtgagtggcaccaatgagtaccagtggcatgattctgtacagtgcagctgttactattgtcatataatcaa

SEQ ID NO: 406 - DNA, 3714 bp, Chickpea
agaagattaggtcacttgtggttttgaagaagctttcttaggttctttgggttttggttctaagcaagtcattcccttcttgtggattgaagatcttactttctcttttgaagattgagcttgtttctatgctacattggtgcttttgatttcttccacaagaacactagaagggtatcttggaaatttaatttgtatatgtttgttggtaggtgtgaaagatactagttactgtcatccttttgaacttgaagagtgaaagctatgaagctctttacccttttagttttatttttatctttcttttccattatgggacagcttccttcacaggacattttagcattgttggaatttaagaaatgcatcaagcatgaccctactggttatgtcctgaattcatggaatgaggaatccattgactttgatggatgtccatcttcatggaatggagttctttgtaatggtggtaatgttgccggtgttgtacttgataacttaggtctttctgctgatactgatttgagtgttttttcaaatctatcaaagcttgtgaaactttccatggccaacaattccatatcaggaaaactaaccaacaatgttgccgatttcaaaagccttcaatttcttgatatttccaataacctcttttcgtcatccataccgtccggaattggtaaattcgatagcttgcagaatctgtcattggctggaaataacttttctggtccaattccaaacactatttcagaaatggcttccatcgaatcattagacttgagccgcaacaccctttctgaagcgctaccaccgtcgttgactaagctgaatagcattgtatctcttaacttgtctcataatggcttcactggaaaaattcccaaaggctttgagcttatttctagccttgaaaaactcgacttgcacagtaatatgcttgatggtcctttagatgttgaatttatgcttttatcaggtgccagctatgttgatttaagtgataacctgctggtgagttctgattctgggaaatttctaccacgaatatctgaaagtattaagtatttgaatctaagccacaaccagcttactggttcattggttggtggagctgaacaacctgttttccaaaacttgaaggtgttggacctcagctataaccaattgaatggtgaattacctggatttgattttgtttatgatctccaggtccttaagcttagcaacaacagattttcaggatttattccgaacggcttacttaaaggagattctttggttttaactgaactggatttgagtgccaacaatctctcggggccattgagtatgattacatcaacaacacttcactctcttaatctctcgtcaaatggtttcactggtgagctgccgctgctgactggaagttgtgctgtacttgatctatcaaacaacaaatttgaaggaaatttaaccaggatgttgaaatgggggaacgtagaatatctcgatctcagtcgaaatcatttggcagggaacatccctgaggtaactcctcagtttttgcgaatgaattatttgaatctatcgcataatgatcttagtcacgaccttccaagagtgttaacacagtatccaaaacttagagtgcttgatatcagttccaaccaatttaaaggcctacttctacctgattttttcacaatgcaaacattacaagagctccatcttgaagataatttgatctctggtagcatcaatttatcatcttctcttgaccaatctcatcttcaagttcttgatctttctcacaaccagcttactagctttttcctgatgatcttggctcattaactagcctgaaagttctcaatattgctggaaatagttttgttggttctcttccgaccactattgctgacctgagttctctagactccttggatatatcagataatcattttactggtccacttccaaataacatgccaaagggactcaaaggcttcaatgcttcaaacaatgatctatctggagttgtaccagaaactcttaggaagttccctagttcttctttctttcctgggaatgctaagttacattttccaaacagtcctcctggatcaaccctttcacctactgaaagttcggagggaaagaagtccatgaccactgttgttaaagtaataattatagtgtcatgtgtggttgctctcttcatattaatcttactggctgtcttcatacactacatacgtatgtcaagatctcctacaccagaatatgacacaggtaaggatatccgtggacgctcgcagccagttatctctggaccagttcgttcgacagagaggggtggtgctttggttgtatcagccgaggaccttgtggcctcacgtaaagggtcgccatcggaaatagttagtcctgatgaaaaagttgcagctgtagctggattctctccatcaaaacacagccacttttcatggtcaccagggtctggtgattcattgactgctgaaaatctctcaagactagatacaaggtcgccggataggttgattggtgagctgcattttctcgatgattcgatatcactaacacccgaggagctatcaagggctccagctgaagttttgggaagaagtagtcatggtacttcttacaaggcaactctggataatggtttgttgttgagagtaaagtggttgagagaaggagtggcgaaacaaaggaaagaatttgttaaagagataagaaagtttgcaaacatcaggcatccaaatgtcgtcggtttgagaggttattattggggtcctacgcagcatgagaagcttattctttcagattacatttcaccaggaagtcttgcaagttttctttatgatcgacctggaagaaatggtccgccattaacatgggctcagaggctcaaaatagcagttgatgtagcacgtggcctgaactatctccattttgaccgagctgttcctcatggaaaccttaaagctacaaatgtgttgttagatacatctgatatgaatgcacgcgtagccgattattgtcttcaccgacttatgactcaggctgggacaatcgaacagattcttgatgctggtgtcttaggttatcgtgcaccagagttagctgcttccaaaaagccaatgccatcattcaagtcagatgtctacgctttcggcgtgatactcttggaacttttatccggaaggtgtgctggcgatgtaatatctggtgaggaaggaggtgttgatcttacagattggctaagattacgagtagcagaaggtcgaggctcagaatgttttgatgtgactttgatgtcggaaatgggaaatccagttgtagaaaagggaatgaaagaagtcctaggaatagcaattcgatgcattcgatcggtttctgaaaggcctggtatcaagactatatatgaagatctttcttctatatagtatggctcatgctaactacttgaactttgacctgtcatgggaatcaatgtctcattggtatctcgtatatttatttgttaagagcatggctttttaacatgtttgtattaaccatttttttgtttgttaatgtaaagcacatacatggctagtacatcatgattggtaggatatgatcatctaattttgtcttaaaatgggatgtgtcatgaatgatcatttgtctgcaagtatctgagatgaagcttgtaaaagttgg

SEQ ID NO: 407 - DNA, 3800 bp, Medicago
ttgtactttagttatgagattttctgattttgaaagttttaatttttgtactcaattctaaagtttgatacttgaagattaggtcacttgtggatttgaagaagctttcttggattctttggattttgacagtaagaaagtccttccttttttgtggatttagcttgaggacctatttgaagattgagcttggttctaactaagctataacaagaagggtattttggaaatttaatttgtacatgtttgttggcagtgttgaaagatactagtagttgctatccttttgaagtagaagagtcaaagctatgaagctctttagtcttttagtgttatctttatctttctttagtattactattatggggcagcttccttcacaggacattttagcattgttggaatttaagaaatgcattaagcatgaccctactggttatgttctgaattcatggaatgaggaatccattgactttgatggatgtccatcttcatggaatggtgttctttgtaatggtggtaatgttgctggtgttgtccttgataacttaggtctctctgctgattctgatttgagtgttttttcaaacctctcaaagcttgtgaaactttccatgtccaacaattccatatcgggaaaattaccaaataacattgccgatttcaaaagccttgaatttcttgatatttccaataacctcttttcctcatccataccggctggaatcggtaagtttggtagcttgcagaatctgtcgttggccgggaataacttttccggtccaattccaaactctatttcagaaatggcttccattaaatctttggacttgagtcgcaacgccctttctggagctctgccgtcgtcgctacctaagctgaatagtcttgtatcacttaacttgtcctacaatcgcttaaccggtaaaattcccaaaggtttcgaacttatttccagccttgacaaactcgatttgcatgggaatatgtttgatggtcctttagacgttgagtttatgcttttatctagtgctagctatgttgatttaagtgataacatgctactgagttctagttctgggaaatttctaccgggaatatctgaaagtattaagtatctgaatctaagccacaaccagcttactggcatattggttggtggagctgaacaacctgttttccaagacttgaaggtgttggatctcagctataaccaattgaatggagaattgcctggatttgattttgtttatgacctccaaatccttaagcttagcaacaacagattttcaggatttattcctaatggcttgcttaaaggtgattctttggttttaactgaactcgatttgagtgccaacaatctctcagggccattgagtatgattacatcaacaacacttcactttctgaatctctcgtcgaacggtttcactggtgagctgccactgcttactggaagttgcgccgtacttgatctgtcaaataacaaatttgaaggaaatttaaccaggatgctgaaatgggggaacatagaatatcttgatctcgggcggaatcgtttggcagggaatgtccctgaggtaacacctcagtttttgcgattgaattatttgaatctatccaataatcgtctcagtgacgaccttccaaaagttttaacacaatatccaaagcttagagtgcttgatatcagttccaaccaattaaaaggtgttcttctaaccgaattgttcacaatgccaacattacaagagctccatcttgaaaataatttgatcaatggtggcatcaatttatcgtcttctcttgaccaatctcatcttcaagttcttgatctttctcacaaccaacttagtagtttttttcctgatgagtttggatcattaactagcctgagagtactgaacattgctggaaataactttgctggttctcttccaaccactattgctgacatgagttctttaaactcccttgatatatcaaataatcgttttaccggtccacttccaaatagcatgccaaagggactcagagactttaatgcttctgaaaatgatctatctggagttgtcccagaaattcttaggaatttccctagttcttctttctttcctgggaatgctaagttacattttccgaatagtcctcctggatcaacggtttcacctaccaaaagttccaaggggaagtctatgtccacagctgttaaagtaataatcatagtctcatgtgtggttgctcttttcatattaatcttactggctgtcttcatacattacatacgtatgtcgcgatcttctacatcagaatatgatacagctactggtaaggatacccgcggtcgccctcaaccagttatctctggaccgattcgtccgacagagaggggggctcctttggttgtatcagctgaggatctcgtggcttcacgtaaaggatcaccatcagaaataattagccctgatgcaaaaactgctgctgtagctggattctctccatcaaaacacagccagttttcatggtcacctgaatctggtgattcattgactgctgaaaatcttacaagactggatacgaggtcgccggacaggttgattggagagctgcattttcttgatgatacaatatcactgacacctgaggagctatccagggcaccagctgaagttttgggcagaagtagtcatggtacttcttacaaagcaactttggataacggtttgttgttgagagtgaagtggttgagagaaggagtggcgaaacaaaggaaagagtttgttaaagagataaggaagtttgcaaacatcaggcatccaaatgttgttggtttgaaaggttattattggggtcctacgcagcacgagaagcttattctttcagattacatttcaccgggaagtcttgcaagttttctttatgatcgaccaggaagaaacggtccaccattaacatgggcacagaggctcaaaatagcagttgatgtagcacgtggcctgaactatctccattttgacagagctgttcctcatgggaaccttaaagctacaaatgtgttgttagatacagctgatatgaatgcacgtgtcgctgattattgtcttcaccgacttatgactcaagctggtactattgagcagattcttgacgccggtgtcttaggttatcgcgcaccagagttagctgcttccaagaagccaatgccttctttcaagtcagatgtctatgctttcggcgtgatacttttggaacttttaaccggaaggtgtgctggtgatgtgataactggtgaggagggaggtgttgatcttacagattggctaagattgcgagtagcagaaggtcgaggctcggaatgtttcgatgcaactttgatgtcggaaatgggaaatccagttgtagaaaagggaatgaaggaggtcctaggaatagcaattcgatgtattcgatcggtttctgaaaggcctggaatcaagactatatatgaagatctttcttctatatagtttgttggctccagctaactacttggaactttgacatgtggaatcaatgtctcattggtatcatcccatatttgtttagagcatggctttttaacatgtttgtattaaccaatttttgttaatgtaaagcagatacatgggtagtacatgattggatatgaccatttgattttgtcttaaaatgggaatgtgtcatgaaatgatcatttgtttagcaagagatgaatgttgtacaatttggcagtggaatggtttagcagttctatttgtggttaatttaattgtttgcta

SEQ ID NO: 408 - DNA, 1863 bp, Soybean
ctgcacacaaccactctttcttcttcttctcttaaaagagcctttgctttttctttaggcctttccgaattaagtacttgtttcattttctctcgaagcaagaaaaatgttcatcgagagtttcaaggttgagagtcctaacgtgaagtacacagagactgagattcagtccgtgtacaactatgaaaccactgaacttgttcacgagaacaagaatggcacttatcagtgggttgtcaagcccaaaactgtcaaatatgaatttaaaaccaacacccatgtccctaaactaggggtaatgcttgtggggtggggtggaaacaatggctcaaccctcaccggtggtgttattgctaaccgagagggtatttcatgggcaacaaaggacaagattcaacaagccaattactttgggtcgctgacccaggcatcagctattagagttgggtctttccaaggggaggaaatatatgccccattcaagagcctgcttccaatggtaaaccctgatgatgttgtgtttgggggatgggatatcagtaacttgaacctggcagatgccatggccagggccaaggtgtttgatatcgacctgcagaaacagttgaggccttacatggaatctatggttccactccccggaatctatgaccccgatttcattgctgccaaccaaggagaccgtgccaacaacgtgatcaagggcacaaagaaagaacaagttcaacaaatcatcaaagacattaaggagtttaaggaaagcactaaggttgacaaggtggttgtcctgtggacagccaacacagagaggtacagcaacctagttgtgggactaaacgacaccatggaaaacctctttgcttccttggacaggaacgaggctgagatttccccttccaccttgtatgccattgcttgtgttatggaaaatgttcctttcatcaatggaagccctcagaacacctttgtcccagggctgattgatctggccatcaagaggaacagtttgattggaggagatgactttaagagtggtcagaccaaaatgaaatctgtgttggtggatttccttgtgggggccggcatcaagccaacatctatagtgagttacaaccatctgggcaacaatgatggcatgaatctctcagcccctcaaaccttccgctctaaggaaatctccaagagcaatgttgttgacgatatggtcaacagcaacgccatcctctatgagcccggtgaacatccagaccatgtggttgtcattaagtacgtgccttatgtaggggacagcaagagggccatggatgagtacacttctgagatattcatgggtggaaagaacacaattgtgttgcacaacacatgtgaggattcactgttagctgctcctattatcttggacttggtccttcttgctgagctcagcactcgaatcgagtttaaagctgaaaatgagggaaaattccactcattccacccagttgcgaccatccttagttacctgaccaaggcccctctggttccaccgggtacaccagtggtgaatgcgttgtcaaagcagcgagctatgctggaaaacatcctgagggcttgtgttggattagctcctgagaacaacatgatcctagagtacaagtgaagttcaaagtcttaagagtaacggtttgggatagtgtagttgaatgtgatcaaaacttaactcatatcccatacccctcttttctgttatatagttctggcaaatgtgaaatttgaagatcgttgaatctctctatctttgttcctgccgacttatttgagagcaggctatctatgcatgtatgtaataaaataatatcaagttatccacgtcttttgtgctta

SEQ ID NO: 409 - DNA, 1876 bp, Pigeonpea
atattcaggctgcttctacgtcaaactgcacaacacaaccactcttcttctctaggaaaaaaaagaaaagcttttctttctttttgccttacttagtaacaaaaatgttcgtcgagagtttcaaggttgagagtcctaacgtgaagtacacagagactgagattcagtccgtgtacaactatgaaaccactgaacttgttcaccagaacaagaatggcgcttatcagtgggttgtcaaacccaaaactgttaaatatgagtttaaaaccaacacccatgtccctaaactaggggtaatgcttgtggggtggggtggaaacaatggttcaaccctcactggtggtgttattgctaaccgagagggtatttcatgggcaactaaggacaagattcaacaagccaattactttgggtcgctgacccaagcatcagctatcagagtggggtctttccaaggagaggaaatatatgccccattcaagagcctgcttccaatggtaaaccctgatgatattgtgtttgggggatgggatatcagtaacttgaacctggctgatgccatggccagggccaaggtttttgatatcgacctccagaaacaattgaggccttacatggaatccatggttccactccccggaatctatgacccagatttcattgctgccaaccaaggagaccgtgctaacaacgttatcaagggcacgaagaaagaacaagttcaacaaatcataaaagacattaaggagtttaaggagacaagcaaggttgacagggtggttgtcctgtggacagccaacacagagaggtacagcaacgtcgttgtgggactaaacgacaccgtggagaacctcttggcttcattggacaggaacgaggctgagatttccccttccaccttgtatgccattgcttgtgtcatggaaaatgttcctttcatcaacggaagcccccagaacacctttgtcccaggcctgatcgatctggccatcaagaggaacagtttgattggaggagatgactttaagagtggtcagaccaaaatgaagtctgtgttggtggatttccttgtgggggctggtatcaagccaacatcaatagtgagttacaaccatctgggaaacaatgatggtatgaatctttcggctcctcaaaccttccgctctaaggaaatctcaaagagcaacgttgttgatgatatggttaacagcaatgccattctctatgagcctggcgaacacccagaccatgttgttgttattaagtatgtgccttatgttggggacagcaagagggccatggatgagtacacttcagaaatattcatgggtggaaagaacacaattgtgttacacaacacgtgtgaggattcacttttagctgctcctatcatcttggaccttgtccttcttgctgagcttagcactcgaatccagtttaaagctgaggatgagggtaagttccactcattccacccagttgcgaccatcctcagttacctgtccaaggcccctcttgttccacctggtaccccagtggtgaatgcattgtcaaagcagcgagctatgctggaaaacatcatgagagcttgtgttggattagctccagagaacaacatgatccttgaatacaagtgaagtacgagaaagagtaatggtttgggtttgggatagtgaagttgaacgtgtccaaaattaactcatattccaaacccctcttttgtgttattgttatgtattgcaagcaaatgttaaattacagatcgtaggatctgtctcgttttgttcctgccagcttatttgatagcaggctgtggcttatctatgcatgtaaaataataccaagtgttttgtgcttagtatattcttgtttctct

SEQ ID NO: 410 - DNA, 1881 bp, Bean
atattgaggttatgtgctacgtgaaagtgcacacacaaccacccatcatcttcttcttcccaacagagtttttctttctaccttcggaaagcaagaaaaatgttcatagagagtttcaaggttgagagtcccaacgtgaagtacacagagagtgagattgagtctgtgtacaactatgaaaccactgaacttgttcacgagaacaagaatggcacttatcagtgggttgtgaagcccaaaactgtgaaatatgaatttaaaaccaacactcgtgttcctaaactaggggtaatgcttgtggggtggggtggaaacaatggctcaaccctcaccggcggtgtaattgctaacagagagggtatttcatgggcaactaaggacaagattgaaaaggccaattactttgggtccctgacccaagcatcagctatcagagtaggatctttccaaggagaggaaatatatgctccattcaagagcttgcttccaatggtaaaccctgatgatattgtgttcgggggatgggatatcagtaacttgaacctggctgatgccatggccagggccaaggtgtttgacatcgacctgcagaagcagttgaggccttacatggaatccatggttccactccctggaatctatgaccccgatttcattgctgccaaccaaggagaccgtgccaacaatgtcatcaagggcacaaagaaagaacaggttcaacaaatcatcaaagacattaaggagtttaaggaaaagagcaaggttgacagggtggttgtcctctggacagccaacacagagaggtacagcaatgtagctgtgggattaaacgacaccgaggaaaacctcttggcttccttggacaggaacgaggctgagatttccccttccaccttgtttgccattgcttgtgtcatggaaaatgttcccttcatcaatggaagccctcagaacacctttgttccagggctgattgatctggctatcaggaggaacagtttgataggaggagatgactttaagagtggtcagacaaaaatgaaatctgtgttggtggatttccttgtaggggcaggcatcaagccaacatcaatagtgagttacaaccatctgggaaacaatgacggtatgaatctttcagcccctcaaaccttccgctcaaaggaaatctccaagagcaatgttgttgacgacatggtcaacagcaacgccatcctctatgaacctggcgaacatcctgaccatgttgttgttattaagtatgtgccttatgttggggacagcaagagagcgatggatgagtacacttcagagatattcatgggtggaaagaacacaatagtgttacacaacacctgtgaggattcactgttagctgctcctattatcttggacctggtccttcttgctgagcttagcactagaatccagtttaaagctgaagatgagggcaagtttcactcattccaccctgttgccaccatactcagttacctgaccaaggcccctcttgttccacctggtaccccagtggtgaatgcattatcaaagcagcgagctatgctggaaaacatcatgagggcttgtgttggattagctcctgagaacaacatgatcctggagtacaagtgaagtagggagaagagagtaacagtttgggatagtgtggttaaatgtgcccaaaattgaacttatatcccatatataccctcttttttcagatatatattgctgctacaaaatgtgaaatttaaagatcttacgatctctgggtctatgttcctgccacttatttgagagcaggctatctacgcatgtaaaataatacgaagttatccaagtgttctgtgcttaattgacgtttctcttccttaacctctt

SEQ ID NO: 411 - DNA, 3127 bp, Pigeonpea
caggggcacccagcatagcaaccgttaacaattctttgattcaagtgcagaagaagtgagggatagagcacaacccttttcttcttcgatcttaataatcgttttcctctgttcctgttctttgtttcatttttaaatcggtggcaaaaatgttcatccacaattttaaggtcgagagtccaaatgtgaagtacaccgagactgagattcagtccgtgtacaactacgaaactaccgaactggttcacgagaacaggaatggcacctatcagtggattgttaaacccaaatccgtcaaatacgaattcaaaactagcactcatgttcctaaattgggggtaatgcttgtggggtggggtggaaacaacggctcaaccctcactggtggtgttattgctaaccgagagggaatttcatgggcaacaaaagacaagattcaacaagccaattactttggctccctcacccaagcctcagctattcgagttgggtccttccaaggagaggagatctatgctccattcaagagcctgcttcctatggttaaccctgatgacattgtgtttgggggttgggatattagtgacatgaacctggctgatgccatggccagggccaaggtgtttgacatcgatctgcagaagcagttgaggccttacatggaatccatggttccactccctggaatctatgacccggatttcattgctgccaaccaggaagaccgtgccaacaacgtcatcaagggcacaaagaaagaacaagttcagcaaatcattaaagacataaaggagtttaaggaagccaccaaggtggacaaggtggttgtcctgtggactgccaacacagagaggtacagtaatttggttgtggggcttaatgataccatggagaacctcttggcttccctggataaaaatgaggctgagatttctccttccactttgtatgccattgcttgtgttatggaaaatgttcctttcattaatggaagccctcagaacacttttgtcccagggctgattgatcttgccatcaagaggaacagtttgattggtggagatgacttcaagagtggtcagaccaaaatgaaatctgtgctggttgatttccttgtgggggctggtatcaagcctacatcaatagttagttataaccatcttggaaacaatgatggtatgaatctctcggctccacaaacattccggtccaaggaaatctccaagagcaacgttgttgatgatatggtcaacagcaatgccattctctatgagcctggtgaacatccagaccatgttgttgtcattaagtatgtgccttacgtaggggacagcaagagagccatggatgagtacacttcagagatattcatgggtggaaagagtaccatcgttttgcacaacacatgcgaggattccctcttagctgctcctattatcttggacttggtccttcttgctgagctcagcactcgaatccagtttaaagctgaaaatgagggaaaatttcacactttccacccagttgctaccatcctcagttatctcaccaaggctcctctggttccaccgggtacaccagtggtgaatgcattgtcaaagcagcgagcaatgctggaaaacattatgagagcttgtgttggattggccccagagaataacatgattctcgagtacaagtgaagaatgggatataatattgttgggtagcctagcttaatgttttctgttaataatgtttgctgatgttttagcaagtgtaattgattgccaactgctcatgaatgctttagagcagggcatgttctgttttctaggcgcttgaatgaatgtataaatttgtgtactttatattcagtcggtgtttatcatcccaccctttccacttttagaggcaaaccacaccgtataatgttaaaacattttctagaaattagttaacttttccaaggtagagttctagttctattttgttaacagacattgatttgtattagttaacttttgctgaaaggtgaaaggtttagctattagctttattacatcattcatggtttagttttgccatttttctgtggagggtcaattaattatgtaaattagggattttatttatattttaccctcgaaaagattttcagaaccttcataagattttatctgatcaaccatatcttcctaaatgaaatgtaactactgtaagcaaaaacatgatcataatgtttagtactactacttaattaagtcagctaattggtcatgagagatactgtgtgttatttttatcttgaaaaatgaatatgttggatggagtaatatgcctccctcttggtagaacctgcgcagaagataattagttggaagcggacagtatcttctcaatcaccttcagtcaggagctcattaattacaacatcaaagaaatatatggctgataatggaagtgattttgttgaagaaccctacatgattgctggaagtcattcgtgcacccttgacagattgtatgcatgggagagaaaactttatgatgtaaattttggtgaattcatcatggaatttgatataaaaaaatgtgataagcttagacatcaatttacaaaagacaaggcactcaagtgattgaaaaaactcaattagtagtgagggatttgcattcaaggataatagtaagtttttattctattgatttaatatctaaacaaattgagacgatgagagatgaagaattgtttccacaaattttggaattaactctagtgcgagttgatttaatcaagtgggtcaaggctttgccttttgaggaactaagtcattcactacaatactttgtgtctgatattcatgacatgatagagcaaaaagataaagaacttcatgaaaaacataatttagatattgcaagcactaatggatcttatagtaaaattaatgtggagagtgaagatgattcttcatcttcatatttgtgttgtatacatgcaagtttaaccaaagttgttcatcaagtcactaaattttgtgagacatcattgaagatgtatgaggatatcaaacaaaaaagtgaagtagttcaaattgtatatcataattgcatgtctattagaaaagagactcaagctagttag

SEQ ID NO: 412 - DNA, 1855 bp, Soybean
caggggcatccaacaaccgttcacaaatcttttctaagtgtagaagaggagaggaaccgcgccaaccctctcttcttcttcttcttcaatccttttataacctttatagtttcattcttaatcgttgggaaaaatgttcatcgagaattttaaggttgagtgtcctaatgtgaagtacaccgagactgagattcagtccgtgtacaactacgaaaccaccgaacttgttcacgagaacaggaatggcacctatcagtggattgtcaaacccaaatctgtcaaatacgaatttaaaaccaacatccatgttcctaaattaggggtaatgcttgtgggttggggtggaaacaacggctcaaccctcaccggtggtgttattgctaaccgagagggcatttcatgggctacaaaggacaagattcaacaagccaattactttggctccctcacccaagcctcagctatccgagttgggtccttccagggagaggaaatctatgccccattcaagagcctgcttccaatggttaaccctgacgacattgtgtttgggggatgggatatcagcaacatgaacctggctgatgccatggccagggcaaaggtgtttgacatcgatttgcagaagcagttgaggccttacatggaatccatgcttccactccccggaatctatgacccggatttcattgctgccaaccaagaggagcgtgccaacaacgtgatcaagggcacaaagcaagagcaagttcaacaaatcatcaaagacatcaaggcgtttaaggaagccaccaaagtggacaaggtggttgtcctgtggactgccaacacagagaggtatagcaatttggttgtaggccttaatgacaccatggagaatctcttggctgctgtggacagaaatgaggctgagatttctccttccaccttgtatgccattgcctgtgtgatggaaaatgttcctttcattaatggaagccctcagaacacttttgtaccagggctgattgatcttgccatcgcgaggaacactttgattggtggagatgacttcaagagtggtcagaccaaaatgaaatctgtgttggttgatttccttgtgggggctggtatcaagccaacatctatagtcagttacaaccatctgggaaacaatgatggtatgaatctctcggctccacaaaccttccgctccaaggaaatctccaagagcaacgttgttgacgatatggtcaacagcaatgccatcctctatgagcctggtgaacatccagaccatgttgttgttattaagtatgtgccttacgtaggggatagcaagagagccatggatgagtacacttcagagatattcatgggtggaaagaacaccattgttttgcacaacacatgtgaggattcccttttagctgctcctattatcttggacttggtccttcttgctgagctgagcactagaatccagtttaaagctgaaaatgagggaaaattccactcattccacccagttgctaccattctcagctatctgaccaaggctcctctggttccaccgggtacaccagtggtgaatgcattgtcaaagcagcgtgcaatgctggaaaacataatgagggcttgtgttggattggccccagagaataacatgattctcgagtacaagtgacgcatgggatagaataataattttgttggggtagcctatccgaatggtttatgttaataatatgtttgcttatgattttgcaagtgtaattgattgcatcttctcattaatgctttagagcaggacatattctgttttctagggacatgaatgaatgtagtataattttgtgtactttatcctcttacc

SEQ ID NO: 413 - DNA, 1854 bp, Peanut
ggttgaatcaacccttcggttccaaccggccgggggcacacaaccacccctaacttcctctccaaagtgtttaatttgcttccctagttagtctccttggtcagcttctcctgactattagctactttctttaggaagaaagtaattaagaaagatgtttatcgagagttttaaggttgagagccctaacgtgaagtacacagagactgagattcagtccgtgtacaactatgaaaccactgaacttgttcacgagaacaagaatggcacttatcaatgggttgtcaagcccaaaaccgtcaaatatgaatttaaaactaacacccatgtccctaaactaggggtaatgcttgtggggtggggtggaaacaacggttcaaccctcactggtggtgttattgctaacagagagggtatctcatgggcaacaaaggacaagattcaacaagccaattattttgggtccttgacccaggcatcagccatcagagtggggtcttatcaaggggaggaaatctatgcccctttcaagagcctccttccaatggtaaacccggatgagattgtgttcgggggatgggatatcagcaacatgaacctggctgatgcgatggggagggcgaaggttttcgacattgatctccagaaacagttgaggccttacatggaatccatggttccacttcccggtatctacgaccctgacttcatcgctgccaaccaagaagaacgcgccaacaacgtgattaagggcactaagaaagaacaagttcaacagatcatcaaagacattaaggcgtttaaggaagctaacaaagtggagaaggtggttgttctatggactgcgaatacagagaggtacagtaacgtggttgtgggactgaatgacacgatggaaaacctcttaagtgccttggacaggaacgagtccgagatctctccctccaccttgtatgccttggcctgtatcttggagaatgttcctttcatcaatggaagcccccagaacacttttgtccctggcctcattgatctctccatcaacaggaacagcttgattggcggcgatgactttaagagtggccagaccaaaatgaaatccgtcttggtcgatttccttgtcggggctggcatcaagccaacatcaatagtgagctacaaccatcttgggaataacgatggaatgaacctatcagccccacaaactttccgctccaaggaaatctccaagagcaacgttgttgatgatatggtcaacagcaatggcatcctctacgagcctggcgagcaccctgaccatgtagtcgttattaagtatgtgccatatgtgggggacagcaagagagccatggatgaatacacttcggagatattcatgggtggcaagaacacaatcgtgttgcacaacacctgcgaggattccctcttagccgcacctattatcttggacttggtcctccttgctgagctcagcacccgtattcagttcaaagctgaaaatgagggcaagtttcactcgttccacccggttgccactatcctgagttacctcaccaaggcccctcttgttccacctggtacaccagtagtgaatgcactgtcaaagcagagagccatgctggaaaacatcctcagagcttgcgttggcttggctcctgagaacaatatgattctcgagtacaagtgaatccaatcaaccactgctttctacatacacgcttctcgcagcctgcgtgtatatcatttcacaaatgtacaatattcatcatgtgtgtctctttttaatttgctcctgctaagttatttgagagcaggtcaattaaatatgcatgtgaaataaaaatctcagtcatc

SEQ ID NO: 414 - DNA, 1944 bp, Cowpea
ggaccctctaacttttcatacaaatctttctacctttcttctcggtgtgcaccgcaatagggcctacccttttgtttgattcttcttcatttcctcttcttcgtttttttcattcttaatctctggtaaaaatgttcattgagaattttaaggttgagagtcctaatgtgaagtacaccgagaccgagattcagtccgtctataattacgaaaccaccgagcttgttcacgagaacaggaacggcacctatcagtggattgtcaaacccaaatccgtcaaatatgaatttaaaaccaacacccatgtccctaaattgggggtaatgcttgtggggtggggtggaaacaacggttcaaccctcaccggtggtgttattgcaaacagagagggcatttcatgggcaacaaaggacaagattcaacaagccaattattttggttccctcacccaagcttctgccatccgagttgggtccttccagggagaggagatctatgctccattcaagagccttcttccaatggttaaccctgacgacattgtgtttgggggatgggatatcagtgacatgaacctggctgatgcgatgggtagggccaaggtgtttgacatcgatttgcagaagcagttgaggccttatatggaatccatggttccactccctggaatctatgacccagatttcattgctgccaaccaagaagaacgtgccaacaatgtgatcaagggcacaaagaaagaacaagttgcacaaatcatcaaagacattaaggagtttaaagcagccaccaaagtggacagggtggttgtcctgtggactgccaacacagagaggtacagtaatttggttgtgggtctaaatgacaccacggagaacctcttggctgctctggacagaaatgaggctgagatttctccctccaccttgtatgccatcgcttgtgttatggaaaatgttccattcatcaacggaagccctcagaacacttttgttccagggctgattgattttgccatcgagaaaaacagtttgattggaggagatgactttaagagtggtcagaccaagatgaaatccgtgctggtagatttccttgtgggggctggtatcaagccaacatcaatagttagttacaaccatctgggaaataatgatggtatgaatctctctgctccacaaaccttccgttccaaggaaatctccaagagcaatgttgttgatgatatggtcaacagcaatgccctcctctatgagcccggtgaacatcctgaccatgttgttgttattaagtatgtgccttacgttggggacagcaagagagccatggatgagtacacttctgagatattcatgggtggaaagagcaccattgttttgcacaacacatgcgaggattctctcttagctgctcctattatcttagacttggtccttcttgctgagcttagcactcgtatccagttcaaggctgaaaaggagggaaaattccactcattccacccagttgctaccattctcagttacctgaccaaggctcctttggttccaccgggtacaccagtggtgaatgcattgtcgaagcagcgtgccatgctggaaaacattctgagagcttgtgttggacttgccccagagaataacatgattcttgagtacaagtgaagcatggattagaagcaaaactttcttggggtgccggcttgaatgttttctgtcaatatgtttggttatgttttcaagtgtaatttggttgcttctgctcatgaatgctttagagcagggcatgtctgttttttctaggtgcatgaatggatgtataatttgtgtccgtccgaattttttgtttattctcctactaccctttatttttatcatttttcagaggcaatccccaatataaagccttttttcttatgagaaaaaagaaattcggagtttacta

SEQ ID NO: 415 - DNA, 1898 bp, Lotus
aatccaccttcaaaaccgttcggtaaatctgcgtcgtcgtgaagaagaagaaagaagagatcgatcgatcgcgtttcatcttcttctttcttctctggtcgcgtttcaccttcatcttcatcatgttcatcgagaatttcaaggttgagagtccgaatgtcaagtacaccgagactgagattcagtccgtgtacaattacgaaaccaccgaactcgttcatgagaacagaaatggttcttatcagtggattgttaaacctaaatctgtcaaatatgaattcaaaaccagtaccaatgttcctaaattaggggtaatgcttgtgggttggggtggaaacaacggttcaactctcaccggtggtgttattgctaacaaagagggtatttcatgggcaacgaaggataagattgaacgagctaattactttggctctctcacccaagcctctgctatcagagttggttctttccagggagaggaaatctatgcgccgttcaagagtttgcttccaatggtcaaccctgatgacgttgtgtttgggggatgggatatcagtgacatgaacctggctgatgccatgggcagggcgagggtgttcgacattgatttgcagaagcagttgaggccttacatggaatccatggttccactccctggaatttatgaccccgatttcattgctgccaaccaaggtgaccgcgccaataacgttatcaagggcactaagaaagagcaaattcaacaaatcatcaaagacattaaggaatttaaggaagccagcaaagtggacagggttgtcgtcctgtggactgccaacacagagaggtatagtaatttagttgtgggacttaacgataccatggagaatctcttggcttccgtggacagaaatgaggctgagatttctccttcaacattgtatgccattgcttgtgttatggagaatattcctttcatcaacggaagccctcagaacacttttgtcccagggctgattgatcttgctatcaagaaaaacagtttgattggtggagatgacttcaagagtggtcaaaccaaaatgaagtctgtgttggtggatttccttgtgggggctggtatcaagccaacatcaatagtgagttacaatcatctgggaaacaatgatggcatgaatctctcagctccgcaaaccttccgctccaaggaaatctccaagagcaacgtcgttgatgatatggtcaacagcaatgccatcctctatgagcctggtgaacatccagaccatgttgtagtaattaagtatgtgccttacgtggcggacagcaagagagccatggatgagtacacttctgagatattcatgggtggaaagaacacaattgtgttgcacaacacgtgcgaggattcgctgttagctgctccaatcatcttggacttggttctccttgctgagcttagcactcgaatccagtttaaatctgaagctgaggacaagtttcactcattccacccagttgctaccatcctcagttatctgaccaaggctcctctggttcctccaggcacacccgtggtgaatgcattgtcaaagcagcgagcaatgctggaaaacatcctgagagcttgtgttggattggctcctgagaataacatgatcctcgagtacaagtgaaacatgggtagaaatagaatgtagttggagttctctagctgaatgctgagaaaatttgtctccttttcccctatcgttgagaatgtgtttgctaaatgttttcacaagtgtaatattttgattgtctttgctcccaagtgctcaatagcatattttgctttctagtgaagtgaatgtataaatttgtgttctcagatggtctttaattttttactatttttcagaggtagtacccattatagt

SEQ ID NO: 416 - DNA, 1807 bp, Lotus
cccttctcttctcttcctataatagctttctttcttctctgaagttgtttgtttttttctctgaattagcaaaaatgttcattgagagtttcaaggttgagagtcctaacgtgaagtacactgagactgagattcagtccgtgtacaactatgaaaccactgagcttgttcacgagaacaagaacaacgcttaccagtgggttgttaaacccaagactgtcaaatatgaatttaaaaccaaaaccaatgtccctaaacttggggtaatgcttgtgggatggggtggaaacaatggttcaacactcactggtggtgttattgctaacaaagagggtatttcatgggcaacaaaggacaagattcaacagtccaattactttggttctctgactcaggcatcagctatcagagtggggtctttccaaggggaagaaatctatgccccattcaagagcctgcttccaatggtgaaccctgatgacattgtgtttggaggatgggatatcagcaacttgaacctggctgatgccatggccagagccagggtctttgacattgacctgcagaaacaattaaggccttacatggaatccatggttccactccccggaatctataacccggatttcattgctgccaaccaaggagagcgtgccaacaatgtcctcaaaggcaccaagaaagaacaagttcaacaaatcatcaaagacatcaaggagtttaaggaagccaacaaggttgatgagattgttgtcctgtggactgccaacactgagagatacagtaatgtagttgtgggactaaacgacactgaggaaaacctcttggcttccttggacagggatgaggctgagatttccccttccaccttgtatgccatagcttgtgtcatggaaaacattccttttatcaatggaagccctcagaacacctttgtcccagggctgattgatctggccatcaggaagaacagtttgatcggtggagatgacttcaagagtggtcagaccaagatgaaatctgtgttggtggatttccttgtaggagctggtatcaagccaacatcaatagtgagttacaaccatttaggaaacaatgatggcatgaatctgtcagccccacaaaccttccgctctaaggaaatctccaagagcaacgttgttgacgacatggtcaacagcaatgccatcctctttgagcctggtgaacatccagaccatgttgttgttattaagtatgtgccctacgtggcggacagcaagagggccatggatgagtacatctcagagatattcatgggtggaaagaacaccatcgtgatgcacaacacgtgtgaggattcactgttagcagctcctatcatcttggacttggtcctccttgcagagctgagcactagaatccagttcaaggctgaaaatgagagcaagttccactcattccaccctgttgctaccatcctcagttacttgaccaaggctcctcttgttccaccaggcacaccagtggtgaatgcattgtcaaagcagagagctatgctggaaaacatcatgagagcttgtgttggattggctcctgagaacaacatgatcatggagtacaagtgaaggatggaaaagaggaacggttgggatgacaagttgaatattgtgccttaaattcatccacccctctttgctgctgaatatgaacgtgtttgctagcaaatgtaaaatcttaagttggttttatttaactgtgtttgctcctgcccagttatttgagagcaggtcatctaaagtatatgaaataaaattttgagttactc

SEQ ID NO: 417 - DNA, 2142 bp, Peanut
ggggactaactacatgcagcagcacctacactgaaaaaaataaaaaaacttcgaaaccgttttcacgaatcttggggagaagagaggaagcacagcacagcctccaaaaaaaaaaaaagaaaaaaagaaaaaagaaaagaaactaaagaaaagaaaaagaaagaaaaaaaaaacctttctctctctgatctcctcttttagttttcccggaaagcacacacccaaaaaagaaaaagaaaaaaaaagtagttgttgtttgtgttgtttgtgaaaatgtttatcgagaagtttaaggttgagagtcctaatgtgaagtacagtgaggatgagattgagtccgtgtacaactacgaaaccacggagcttgttcatgagaacaggaatggttcttatcaatggattgttaaacccaaaaccgtcaaatacgaattcaagaccaacacccatgtccctaaattgggtgtaatgcttgttgggtggggtggaaacaatggcagcacactcactggtggcgttattgcaaaccgagagggaatttcatgggcaacgaaggacaagatccaacaagcgaattactttgggtctctgactcaagcctctgctatcagagtggggtcttaccaaggagaggaaatttatgccccattcaagagcctcctccctatggttaaccccgacaacattgtgtttggtggatgggatatcagcaagatgaacctggcagatgccatggcaagggccaaggtattcgacatcgatttgcagaagcagttgaggccttacatggaatccatggttccactccctggaatctatgaccaagatttcattgctgctaaccaagaagcgcgcgctgacaacgtcatcaagggcactaagaaggaacagattcagcagatcatcaaggacattaaggaatttaaggaacagaacaaagtcgatagggtggttgtcctgtggaccgccaacaccgagaggtatagcaatgttgttgttggtcttaacgacaccatggagaacctcatggcttctgtggacaaaaatgagtcagagatctctccttccaccttgtttgcaattgcttgtgttatggagaatgttcctttcatcaatggaagccctcagaacacttttgtcccagggctaattgatcttgccatcagtaggaacagtttgattggtggagatgatttcaagagtggccaaaccaaaatgaaatctgtattggttgatttccttgttggtgctggtatcaagccaacatcaatagtgagttacaaccatcttggaaacaatgatggtatgaatctctcagccccacaaacctttcgatcaaaggaaatctccaagagcaacgttgttgatgatatggtcaacagcaatgccatcctctatgagcctggcgagcacccggaccacgttgtcgtgattaagtatgttccttatgttggggacagcaagagggccatggatgagtacacatcggagatattcatgggcggaaagaacacaatcgtgttgcacaacacctgtgaggattccctcttggctgctcctattatcttggacttggtccttcttgctgagcttagcactcgaattcagttcaaatccgaagctgagggcaagttccactcattccacccggtcgcaaccatcctgagttatttgaccaaggcccctttggttccaccgggcacgccagtggtgaatgcattgtcgaagcagcgagcaatgttggaaaacataatgagagcttgtgttggtttggcaccggagaacaacatgattctagagtacaagtgaatcgaattcgaatctgtgggcaagaagcagtagtttgaaagaataatcttggctgaatgttttggagccgttattatcccctggctgctcccttttttcttttttctgttgcttaggacgtttgcaagtgtaatattttgctttggtttctgtgttgctttaccatagggaagggcagttattttgttttccttggtgcataaatatgttaggtttgtgtgctttgtggaatcaaatgaaaagcataaaacaaaaaaaagaagttatgttcttggtcttaaattggtttatgaaccacagtttagactacaatgcattataagtatcaactttatc

SEQ ID NO: 418 - DNA, 1987 bp, Tobacco
ggagtgcaagtggaggtcttagccttaagtatactcatagcgtgttcttctctttgtttgttacaattacaaaacctttcccctttgatcctttctaaagtttcctcaaaatgtttattgagaactttaaggttgagagccccaacgttaagtacaccgaaagtgagattcactctgtctatgattatcaaaccactgagttagttcatgaggagaaaaatgggacttaccaatggactgtcaagcctaagactgtcaaatatgagttcaagactgatgttcatgttcccaaattaggggttatgcttgttggatggggtggaaacaatggttcaaccttgaccggtggtgttattgctaacagagaaggaatttcatgggccaccaaagataaggtgcaacaagccaattactttggctctcttactcaggcttctactattcgagttgggtctttcaatggagaagagatctatgctccatttaaaagcctccttccaatggtcaatccagatgacgtagtgtttggaggatgggacatcagcgacatgaatttggcagatgccatggcaagggctaaggtatttgatattgatctacaaaagcagttgaggccctacatggaatctatggtcccactacctggtatctatgatcctgatttcattgctgctaaccaagggtcacgtgccaacaacgtgatcaaaggaaccaagaaagaacaaattgatcaaatcattaaggatattagggagtttaaggagaagaacaaagtggacaaggtggtagtcttgtggactgctaacactgaaagatacagtaatgtggttgttggacttaatgatactatggaaaatctctttgcttctgtggacagaaatgaagctgaaatatctccttccactttgtatgctattgcctgcattcttgaaaatgtgccttttattaatggaagcccacagaacacctttgtgccaggcctcattgatttggccatcaagaggaacacactgattggtggtgatgactttaagagtggtcaaaccaaaatgaagtcagtgctggttgatttccttgttggagctggtattaagccaacatcaattgtgagctacaaccatttgggtaacaatgatggaatgaatctgtctgcccctcaaactttccgctcaaaggagatctcgaaaagtaatgttgttgatgacatggtttcaagcaatgccattctttatgagcctggagagcaccctgaccatgttgttgtgattaagtatgtgccatatgtgggagacagcaaaagggcaatggatgagtacacatctgagattttcatgggaggaaagaacaccattgttttgcacaatacttgtgaggattctcttttggctgctccaattatcttggatttggtccttcttgctgaactcagtacccgcattcagctcaaagctgaaggagagggtaagttccactccttccaccccgtggctactatcctcagctaccttaccaaggctcctctggtaccaccaggtacaccagtggtgaatgcactctcaaagcagagggcaatgcttgagaacatattgagggcttgtgttggacttgcaccagagaacaacatgattctggaatacaaatgaagatcggaaaggactcaagaagctgtacggcagaagaaccataattgtcttactcaagaagctgtgcagcagatgaaccataattgtctttcttttctttagtatttgtaatctttatctttcattagtactatgatattagctaaatgttggcagcccttcgaggtatagctgttttttaatggcaggccaagttgaatgtcatcataatttctttgttgtctttgtatgttggccttctatttacaatgttgtatccgtgttgctcttgctcatttagagatagcaacgcttttctcaattggaaatacaatgtgtagtcctttagacgttaatcaaaaaaa

SEQ ID NO: 419 - DNA, 2051 bp, Bean
ccgttatattcatggccaccctctaatctttcacaaatctttctacctttccacattagcgcccacccctttgcttcattcttcttcaattttcattcttaatctctgaacaaacaaaaatgttcattgagaattttaaggttgagtctcctaatgttaagtactccgagactgagattcagtccgtctataactatgaaaccaccgaacttgttcacgagaacagaaatggcgcctatcagtggattatcaaacccaaatctgtcaaatatgaatttaaaaccaacacccatgttcctaaattgggggtaatgcttgtggggtggggtggaaacaacggttcaaccctcactggtggtgttattgctaaccgagagggcatttcatgggcaacaaaggacaagattcaacaagccaattactttggctccctcacccaagcttccgctatccgagttggctcctaccagggagaggaaatctatgccccattcaagagccttcttccaatggttaaccctgacgacattgtgtttgggggatgggatatcagtaacatgaacctggctgatgccatgggtagggccaaggtgtttgacatcgatttgcagaagcagttgaggccttatatggaatccatggttccactccctggaatctatgacccagatttcattgctgccaaccaagaagagcgtgctaacaatgtgatcaagggcacaaagaaagagcaagttcaacaagtcatcaaagacattaaggagtttaaggcagccaccaaagtggacaaggtggttgtcctgtggactgccaacacagagaggtacagtaatttggttgtcggtcttaatgacaccacggagaacctcttggctgccctggacagaaatgaggctgagatttctccttccaccttgtttgccattgcttgtgttacggaaaatgttccattcatcaacggaagccctcagaacacttttgtcccagggttgattgattttgccatccagaaaaactgtttgattggaggagatgacttcaagagtggtcagaccaaaatgaaatccgtgctggtagatttccttgtgggggctggtatcaagccaacatcaatagttagttacaaccatcttggaaacaatgatggtatgaatctctctgctccacaaaccttccgttccaaggaaatctccaagagtaacgttgttgatgatatggtcaacagcaatgccatcctctatgagcctggtgaacatcccgaccatgttgttgttattaagtatgtgccttacgttgcggacagcaagagagccatggatgagtacacttcagagatattcatgggtggaaagaacaccattgtgctgcacaatacatgcgaggattctctcttggctgctcctattatattggacttggtccttcttgctgagcttagcactcgtatccagttcaaagctgaaaaggagggaaaattccactcattccacccagttgctaccattctcagctacctgaccaaggctcctctagttccaccgggcacaccagtggtgaatgcattgtcaaagcagcgtgcaatgctggaaaacattatgagagcttgtgttggattggccccagagaataacatgattcttgagtacaagtgaagcgtgggatagaagcatcacttattggggtagccagcttgaatgttttctgttaatatgtttgcttatgttttcgcaagtgtagtttattgcatctgctttcgaatgctttagagcggggcatgttctcttctttcctaggtacatgaatgaatgtataaatttctgtccgttatcccaaatttgtgtttattctcctactacccttcttcatttttattatttttcagaggcaatccccaatataataataaccttaaagcattttcttataagaaaaaaaaattcagagtttacaaattactgtgtattgtgtgttgtcaaaatggttctaaaatatgaatccacatgcaaccacactttcaccatactcatctacttcaaagcatattctcactt

SEQ ID NO: 420 - DNA, 1852 bp, Chickpea
gtaggcctccttaacacggaggtactcttctagaatgtgaagttttaactaaagtcaccttttcttctctttgtgttatatattttcttcaagtaacgaaaatgttcattgagagttttaaggttgaaagtcctaacgtgaagtacacagatactgagattcagtcagtatacagttacgaaacaaccgaacttgttcatgaaaaccgaaataacacttatcagtgggttgtcaagcccaaaaccatcaaatatgaatttaaaacccaaacacatgtccctaaattgggggtaatgctcgtggggtggggtggaaacaatggttcaaccctcactggtggtgttattgcaaaccgagagggtatttcatgggcaacaaaggacaagattcagcaatcaaattattttggttcgctgactcaggcatcagctattagagtggggtctttccaaggggaggaaatttatgccccattcaaaagccttcttccaatggtaaaccctgaggacattgtgtgggggggatgggatatcaataacatgaacctagctgatgccatgggcagagccagggtgtttgatatcgaccttcagaaacaattaaggccttacatggaatcaatggttccactccctggtatctatgaccctgatttcattgctgctaatcaaggagatcgtgctaacaacgttattaatggaactaagaaagaacaactccaacaaattatcaaagacatcaaggagtttaaggaagcttctaagattgacaaggttgttgtactgtggactgctaacacagagaggtacagtaatgttgttgtgggactaaatgacaccatggaaaatcttttggcttctgtggataagaatgaagctgagatttccccttcaaccctttatgcattggcttgtgttcttgaaaatgttcctttcatcaatggaagccctcaaaacaccttcgtcccagggttgattgatctggccatccaaaggaacagtttgatcggtggagatgattttaagagtggtcagacaaaaatgaagtctgtgttggttgattttcttgttggggctggtatcaaaccaacatcaatagtgagttacaaccatttgggaaacaatgatggaatgaatctctcagctccacaaacattccgctctaaggaaatctccaagagcaatgttgttgatgatatggtcaatagtaatgccatcctctatcagcctggtgaacatccggaccatgtcgtcgttattaagtatgtgccttatgtggcggacagtaagagagcaatggatgagtacatatcagagatattcatgggtggaaagaacacaattgtgttacacaacacatgtgaagattcacttctagcagctcctattatattggacttagtgcttcttgctgagcttagcactcgaattcagttcaaatctcaacatgaggacaagtttcactcattccaccctgttgctaccatcctcagttacctcactaaagctcctcttgtcccaccaggtacaccagtggtgaatgcattgtcaaagcagagagctatgctggaaaatattctaagagcttgtgttggattggctcctgagaacaacatgattctggaatacaagtgaagtaacgattcagttaggaatttggggataactcagtttatttcactgttccaaaaaagttattccatgatgatgatcctctatttgctgctgtattttgatatgttctatagcaccatatcatatgtagaacatttgattgtcatgtcttttctcctgccggcttattttatagcacagagcagataatctaaatatatgaaataatattcagctat

SEQ ID NO: 421 - DNA, 1936 bp, Medicago
atcgatcgcaattcttttacagagaaagaaagaaacagaatcttccttttcatttctttcttctctaaaatccttcattcttttctttcctcttcacaaaaatgtttatcgagaatttcaaagtcgagagtcccaatgttaagtacactgaaactgagattcaatccgtttacaattacgaaaccactgaacttgttcatgaaaatcgtaatggcacttatcagtggattgttaaacctaaaactgttaaatatgaatttaaaaccgatattcatgtccctaaattgggggtaatgcttgtgggatggggtggaaacaacggttcaacccttaccggtggtgttattgctaacagagagggaatttcatgggccacgaaagataagattcaacaagccaattactttggatccttgactcaagcttcagctattcgagttggatcttttcaaggagaggaaattcatgctcctttcaagagcctccttccaatggtcaaccccgatgacattgtttttggtggatgggatatcagtgacatgaaccttgctgatgccatggctagggccagggtttttgacattgatttgcaaaagcaattgaggccttatatggaatccatggttccacttcccggtatctatgacccggatttcattgctgctaatcaaggagaacgtgcgaataacgttatcaagggtacaaagagagaacaaatcaaccaaatcatcaaagacattaaggaatttaaggaagcaaacaaagttgacagggttgttgtactctggactgccaacacagagaggtacagtaacttagttgtaggactcaatgacaccatggagaacctttttgctgctgtggacagaaatgagtctgagatttcaccttccaccctgtttgccattgcttgtgttatggagaatgttcctttcatcaatggaagtcctcagaacacttttgttccagggcttattgatcttgccatcaagaacaactgtttgattggtggtgatgatttcaaaagtggtcagaccaaaatgaaatctgttttggtggatttccttgtaggagctggtatcaagccaacatcaatagtgagttacaatcatcttggaaacaatgatggtatgaacctctcagccccacaaaccttccgctccaaggaaatttccaagagcaacgttgttgacgatatggtcaacagcaatgccatcctctatgcacctggcgaacatcctgatcatgttgtagtcattaagtatgtgccttatgttggtgacagcaagagagctatggatgagtacacttcggaaattttcatgggtgggaagaacactattgtgttgcacaacacatgtgaggactcccttttggctgctcctattatcttggacttggttcttcttgctgagcttagcactagaattcagtttaaatctgaagctgagaacaagttccacaccttccaccctgttgctaccatcctcagttatctgaccaaggctcctctggttccaccgggcacaccagtggtgaatgcattgtcaaagcagcgagcaatgcttgaaaacatcatgagagcttgtgttggattggctccagagaacaacatgatcctcgagtacaagtgaacgaggagatagaaccatagttgttggaactttctagtttctagctgaatcagaaaacttgctactgtcctttttattttattttattttattttccatttggtttgctgatgttttcactagtataatatttgatagtctttgctcccacgtgctttagagcagggcttagcttgtttttgggtacatgaaaatataaatatttatctacttgtgctcaattggtgtttattgcttttaccttatgatacttttaagaggcaagaccaacataatatggtatctaacctttaatttaacaa

SEQ ID NO: 422 - DNA, 1845 bp, Sesame
cggcacgagctcctctttcctctcaaacacagcaaaagaaagaaacgaaaatgttcatcgagagcttcaaggttgagagccccaatgtcaagtacaccgagggtgagattcactctgtctacaactacgagactacagagcttgttcatgagagcagaaacggcacctaccaatggattgtcaagcccaagactgtcaaatacgagttcaaaactgatactcatgtccccaaattaggggtcatgcttgttggatggggagggaacaatggttcaactctcactggcggtgtcattgcaaacagggaagggatttcatgggcaacaaaggataaggtgcaacaggccaattattttgggtcactgacacaggcatcctcaatcagagttggttccttcaatggagaagagatctatgcccccttcaaaagccttcttcccatggtcaacccagatgacgtagtgtttgggggatgggacatcagcaatatgaatttggctgatgccatgggcagggccaaggtgttagatattgatctccagaagcagctcaggccctacatggagcacatggtcccactccctggaatctacgatcctgatttcatagccgccaatcagggatcacgtgccaacaacgtgattaaaggaaccaagaaagaacaagttcaacagatcatcaaagacatgagggactttaaggagcaaaataaggtggacaaggtcgtagtgctgtggacagccaacacagaaagatacagtaatgttgtcgttgggctaaacgatacagccgaaagcctgatggcctcggtagagaggaatgaggccgagatatctccttcaaccttgtatgccatagcttgtgtttttgaaaatgttccgttcattaatggcagcccacaaaatacttttgttccagggttgattgatttggcgattcagaggaacagtttgattggtggagatgatttcaagagcggtcaaaccaagatgaaatcagtgctagttgatttccttgttggagctggtatcaagccaacgtcgattgtgagctataatcatctgggaaacaacgacgggatgaatctatcagcaccccaaactttccggtccaaagagatttctaaaagcaatgtggtagacgacatggttgccagcaacggcatcctttatgagcctggtgaacaccccgaccatattgttgtcatcaagtatgtaccgtatgtgggggacagcaagagagcaatggacgagtacacttcggagatattcatgggagggaaaagtaccatagttctgcacaacacgtgtgaggactctcttctggctgctcccatcatcctggatttggtcctcctagctgaactcagcactcgtattcagctcaaagccgagggagagggcaaattccattcgttccacccggtggcaaccatcctcagctacctaaccaaagcccctcttgtacctccaggcacaccggtcgtcaacgcactgtctaagcagcgtgccatgctcgagaacatcttgagggcttgtgttggattggctccagaaaacaatatgattttggaatacaagtgaaaagaaaaaaaacattgtgggaattggacaaacgggcaaggacaggacacccgtgctgttgttcttgcttagcttttggtattttcttgtaagcgtagtactgggagttagtgtttttccttttttgatgtagttgcaataatggattgaagtgtattttactgttaagtagttgctatgcataaattttatttgtttaagtaaaataaatgatgtgataataaaagaatacaaattcatcttaaaaaaaaaaaaaaaaaaa

SEQ ID NO: 423 - DNA, 1935 bp, Trigonella
tacatttaggatcatcgatcaaccgttcacaattcttttacagagaaagaaagaaagagaatctttctgctttttcttttctttcttcttcatcatctctaaaatccttcatttcagttttcgttaacgacaatgtttatcgagaatttcaaagttgaaagtcctaatgtgaagtacacagaaactgagattcagtctgtctacaactacgaaaccacagaactcgttcatgaaaatcgtaatggcacttatcagtggattgttaaacctaaaaccgttaaatatgaatttaaaaccgatactcatgttcctaaattgggggtaatgcttgtgggatggggtggaaacaacggttcaacccttactggtggtgttattgctaacagagagggtatttcatgggcaacgaaagataagattcaacaagctaattattttggatctttaactcaagcttctgctatccgtgttggttcttaccaaggagaggaaatccatgctcccttcaagagtcttcttccaatggtcaaccctgatgacattgtttttggtggatgggatatcagtgacatgaaccttgctgatgccatggctagggccagggttttcgacatcgatttgcaaaagcaattgaggccttatatggaatctatggtaccactccccggtatctatgacccggatttcattgctgccaatcaaggagaacgtgctaataatgttatcaagggtaccaagagagaacaaattaaccaagtcatcaaagacattaaggagttcaaggaagctaacaaagtagacagggttgttgtactttggactgccaacacagagaggtacagtaatctagttgtgggactcaatgacaccatggagaacctttttgctgctgtggacagaaatgagtctgagatttcaccttccaccttgtttgccattgcttgtgttatggagaatgttcctttcatcaatggaagccctcagaacacttttgtcccagggcttattgatcttgctatcaagaacaactgtttgattggtggtgatgacttcaagagtggtcagaccaaaatgaaatctgttttggtcgatttccttgtaggagctggtatcaagccaacatcaattgtgagttacaatcatcttggaaacaatgatggtatgaacctctcagcaccacaaaccttccgctccaaggaaatctcgaagagcaacgttgttgacgatatggtcaacagcaatgccatcctctatgcgcccggcgaacatccagaccatgttgtagtcattaagtatgtgccttatgttgctgacagcaagagagccatggatgagtacacttcagaaatattcatgggtggaaagaacacgattgtgttgcacaacacatgtgaggattccctcttggctgctcctattatcttggacttggttcttcttgctgagcttagcactagaattcagttcaaatctgaagctgagaacaagtttcacacattccaccctgttgcaaccatcctcagttatctgactaaggctcctctggttccaccaggcacaccagtggtgaatgctttgtcaaagcagagagcaatgctggaaaacatcatgagggcttgtgttggtttggctccagagaacaacatgatcctcgagtacaagtgaagcaggggatagaatcatagttagaactttctagtttctagctgaatcagaaaatttgctcctgtcctttttttcctttggtttgctgatgttttcacaagtgtagtatttgatagtctttgctccaagtgctttagagcagggctttgcttgtgttttgggtacatgaaaatatataaagatttatctactttgtgctcaattggtgtttatagctctaccttatagtacttttaagaggcaagacccaatataatatggtataacctt

SEQ ID NO: 424 - DNA, 1684 bp, Cassava
acgaaggctgagattggtagctaattttctcttcgcttcgcctcccttcccttcctgcgcttgcaatccgaggcttgcttggcttaattttttgtttcctcggattttcctctcatctttaaccccaaaagaaaatgttcattgagaagtttaaggtcgagagtcctaatgttaaatacacagaggacgaggttcactctgtatacaactatgagaccactgagcttgttcatgagaacaggaatggtacatttcaatggattgtcaagcccaaaactgtcaaatacgaattcaagaccaatacccatgtccctaaactaggggttatgctagtggggtggggaggaaataatggttctactctcaccggtggagttattgccaaccgagaaggaatctcctgggcaaccaaggacaaagtccaacaggcaaattactttggttcactcacacaagcatcgtcaatccgagttgggtctttcaatggagaggaaatatatgctccgttcaagagcctcctccctatggtgaaccccgatgacattgtgtttggtggttgggacataagcgacatgaacttggcagatgccatggccagggccaaggtcttcgatattgatcttcagaagcaactgaggccctacatggaatctatggtcccactccctggaatctacgaccctgattttattgccgccaaccaagactcacgtgccaacaacgtgatcaaagggactaagaaagagcaagttcagcaaattgttaaagacattagggagtttaaggagaaaaacaaggtggacaaggtggttgttctgtggactgccaacactgagaggtacagcaatgttgtagtgggcctaaatgacaccatggagaacctcatggctgccttggagagaaatgaagttgaaatatctccatcaaccttgtatgccttggcttgtatttttgaagaggtccctttcattaatggaagcccacaaaacacttttgttccaggcgttattgatttggctattaagaggaacagtttgattggtggagatgacttcaagagtggtcagaccaagatgaaatctgtactggttgatttccttgtgggggctggtattaagccaacatcaatagtgagttacaaccatctgggaaacaatgacgggatgaacctgtcagcacctcaaactttccgctccaaggaaatctccaaaagcaatgttgttgatgacatggtctctagcaatggcatcctctatgaacctggggaacaccctgaccatgttgtagtcatcaaatatgttccttatgtgggagatagcaagagagcaatggatgagtacacttcagagatttttatgggcggccaaaacaccatagtcctgcacaacacctgcgaggactccctcctggctgcacccatcattctggatttggtcctcctcgctgaactcagcaccaggatccagcttaaagctgaagaggagggcaagttccactccttccaccccgtggctactattctcagttacctcaccaaggctcctcttgttccaccaggcacaccagtggtgaatgcgctgtcgaagcagcgtgcaatgcttgaaaacatactgagagcctgtgttggtttagctcctgagaacaacatgatcttggaatacaagtgaaaaaatagaagaagaaa

SEQ ID NO: 425 - DNA, 1843 bp, Cassava
aaaatgttcattgagaagtttaaggttgagagtcctaatgttaagtatacagaggatgagattcactctgtgtatagctacgagaccactgatcttgttcacgagaacaggaatggcacttatgaatggattgtgaagcccaaaactgtcaaatacgaattcaagaccaatacccatgtccctaagctaggggttatgctcgtggggtggggaggaaataatggttccactctaaccggtggggttatagccaatagacaaggaatctcttgggcaaccaaggacaaagttcaacaggctaattactttggctcactcacccaagcttcatcgatccgagttgggtctttcaatggagaggagatttatgctccgttcaagagcctccttcccatggtgaatccagatgacatcgtgtttggtggctgggacatcagtgacatgaacttggcagatgccatggccagggccaaggtctttgaaattgatcttcaaaagcaactgaggccctacatggaatctatggtcccactccccggaatctatgaccctgatttcatcgctgccaatcaagggtcacgtgccaacaacgtgatcaaagggaccaagaaagagcaggtccagcaaataattaaagacattagggagtttaaggagaaaagcaaggtggacaaggtggttgttctgtggactgccaacactgagaggtacagtaatgttgttgtgggcctaaatgataccatggagaacctcttggcttcgttggagaaaaatgaagctgaaatatctccatcaaccttgtatgctttagcttgtgttttagaggaagttcctttcattaatggaagcccacagaacacttttgttccaggccttattgatttggccattaagagcaacagtttgattggtggagatgatttcaagagtggtcagaccaagatgaaatctgtacttgttgatttccttgttggtgccggtataaagccaacatcaatagtgagttacaatcatctaggaaacaatgatggtttgaacttgtcagcacctcaaactttccgttccaaggaaatctccaaaagcaatgttgttgacgacatggtcgctagcaatggcatcctctatgaacctggggagcaccctgatcatgttgtggtcatcaagtatgttccttatgtaggagatagcaagagagccatggatgagtacacttcagaaattttcatgggtggcaaaaacaccatagtcctgcataacacctgcgaggactcccttttggctgcacccatcatcctggatttggttcttcttgctgagctctgcaccaggatccagcttaaagctgaaggggagggcaagttccactctttccaccctgtggctaccattctcagttaccttaccaaggctcctcttgttccaccaggcacaccagtggtgaatgcactgtcaaagcagcgagcaatgcttgagaacatactgagagcttgtgttggcttggctcctgagaacaacatgattttggaatacaagtgaagcaacacgggaggaagaaaatagtggaagaagattggtgccagcaatagcagcaaagaaccaagtttccctgtttctttcactggttgtttatggttaatgtcccatcataaaatgtaatatttgtgtgatattgccatattctggtctatgtatggattttctatttcctttttcttttagcttcagacagtgctcatgcatagcccgtttgcttaggctgttctcatgggccaggcaccttgttttggcttgaaagtagattatatgtataattaggtagttgataaaattctgtctttgcttc

SEQ ID NO: 426 - DNA, 2219 bp, Grape
agtgaaggagcacacaaccagcaacgtctagagcgccagagggagagaagaagctttctcttcttgtttttctctctcactttccaggaaatttattgtttggttcacattttttcccggagaagagaaaaaaaatgttcatcgaaagctttaaggttgagagtcctaatgtcaagtacacagagaatgagattcattccgtgtacgactatgagaccaccgagcttgttcatgagaacaggaatggcacctaccaatgggttgtcaagcccaagaccgtcaaatatgaattcaggaccgatgcccatgtccccaagctaggggttatgcttgtgggttggggaggaaacaacggctcatctctcactggtggtgtaattgccaatcgggagggaatttcatgggcaaccaaggacaaggtgcaaccagccaattactttggctcgctgactcaggcatcgaccatccgagttgggtcctacaatggagaggagatttacgctccattcaagagcctcctccctatggtgaacccagatgacattgtttttgggggatgggacatcagtgacatgaacctggcagatgcaatggccagggctaaggtcctggacattgatctgcagaagcagctgaggccctacatggagtccatggtcccactccctggaatctatgaccctgatttcattgctgccaaccaatgctctcgtgccaacaacgtcatcaaaggcaccaagaaagagcaggtccagcagatcattaaagatattagggagtttaaggaggcaaccaaggtggataaggtggtggtgctgtggactgccaacacagagcgatacagtaatttgattgtgggactgaatgacaccatagaaaatctcttggcttctctggataggaatgagcctgagatctctccttccaccttgtatgctctggcttgtgtcatggaaaatgttccctttatcaatggaagcccacagaacacttttgttccagggctgattgatttggctattaagaggaatagtttgattggtggggatgattttaagagtggtcaaaccaagatgaaatctgtattggtggatttccttgttggggcaggcatcaagccaacatccattgtgagctataaccatctgggaaacaacgatggcatgaatctgtctgctcctcaaaccttccgctccaaggagatctccaagagcaatgttgtcgacgacatggttgccagcaacgctatcctgtatgagcctggggagcaccctgaccatgtggtggtcatcaagtatgtgccatatgttggagatagcaagagagccatggatgagtacacttctgagatattcatgggtgggaagagcaccattgtgctgcacaacacctgcgaggactcactcttagctgctcccatcatcttggatttggtccttcttgctgagctcagcacccgcatccagctcaaagctgaaggagaggacaagtttcattccttccacccagttgccaccatcctcagttacctcaccaaggcccctctggttccaccaggcactccagtggtgaacgcactggcgaagcagcgggcaatgctcgagaacatactaagggcttgtgttggattggctcccgagaacaacatgattttggaatacaagtgaaccagacctcaagactgctctccagaaaataatccctcctcttctataaggacttgtgttgatgttttcaaacatgtaatgtgtgagaaaatctagtagccggtgttcttgttcagtctcagtctctctttttttttttttgcacaatggtgcttacatgtgtattctgtgggctttagctcattgggctaccatctcttttttctagtaaagatacgtaaaagaatttgtgcgtttagtgcaatgatgttgatccattagaaaaacctcacttggttgatacctttgatgtgccttgatgatcctatatgatcttagaatcttcaataatttatggctattaatactatgatagcgatatgcaacttccatatttataattcatgtaggcgtgtagctttgtatcattttcctgacccctcttacccattgatggaaacagagtttaaagatgcacttttgtggcaaatgtaaaattactttcagaaagggaaaaaaggcactcatttgggtcctcaaattgaggtgtaattttccacgaaagggtccata

SEQ ID NO: 427 - DNA, 1971 bp, Medicago
acaccacaacaagtaaccacccttcttgagaaaaataactctcttcctttttttctctcgtgatttgttcattttcttcaagtaacaaaaatgtttatcgagaatttcaaggttgaaagtcctaacgtgaagtacacagagactgagattcagtctgtgtacagttacgaaacaactgaacttgttcacgagaacagaaataacacttatgagtgggttgttaagcccaaaaccgtcaaatatgagtttaaaacacaaacaaatgtccctaaattgggggtaatgcttgttgggtggggtggaaacaatggttcaaccctcactggtggtgttattgcaaaccgagagggtatttcttgggcaacaaaggacaagattcagcaagccaattattttggttcgttaactcaagcatcagctatcagagtggggtctttccaaggggaggaaatacatgccccattcaagagccttcttccaatggtaaaccctgaggatattgtgtggggaggatgggatatcagtaacttgaacctagctgatgccatgggcagagctagggtatttgacatagacctacaaaaacaattaaggccttacatggaatccatggttccacttcctggaatctatgaccctgatttcattgctgctaatcaaggagatcgtgctaacaacatcattaaaggaacaaagaaagaacaacttcagcaagtcatcaaagacattaaggagtttaaggaaactaccaaggttgataaggttgttgtactctggactgccaacactgagaggtatagtaatattgttgtgggactaaatgacaccactgaaaatcttttggcttctgtggacaagaatgaagctgagatttcaccttcaaccctttatgccttggcttgtgttcttgaaaatgttccttttatcaatggaagccctcaaaacacctttgtcccagggttgattgatctggccatcaaaaggaacagtttgattggtggagatgacttcaagagtggtcagacaaaaatcaagtctgtgttggttgatttccttgtgggagctggtatcaaaccaacatcaatagtgagttacaaccatttgggaaacaatgatggaatgaatctttctgcaccacaaaccttccgctctaaggaaatctcaaagagtaacgttgttgatgacatggttaacagcaatgccatcctctatggtcctggtgaacatccagaccatgttgttgttattaagtatgtgccttatgtgggggacagcaagagagcaatggatgagtacacttcagagatattcatgggtggaaagaacacaattgtgatgcacaacacatgtgaagattcacttttggcagctccaattatcttggatttggtccttcttgctgaacttagcactagaatccagttcaaatctgaacaagaggacaagtttcattcattccatgctgttgcaaccatcctcagttacctctctaaggctccacttgttccaccaggtacaccagttgtgaatgcattgtcaaagcagagatctatgctggaaaacattctgagagcttgtgttggattggctcctgagaacaacatgatccttgaatacaagtgaagtgaagtaacagttcggttatataggaatttgggataactcagttcttatgtgccctaaaacttatcccatgctcctttgtttgttgttatattttgatgtgttggttagcatatgtacctaccaacatttgattgtgtcttttctcctgccggcttattttagagcattgagcaggccatgatcttaaacatgtgaaataatattcacttgtcttaagtattttgtgattaattccatatatatagttttggttttctgtatttgtaattcgcacaacatctctaatggattgtgtataacttcaaataacattgaaaatcagaaattagattattaatatagaaa

SEQ ID NO: 428 - DNA, 1645 bp, Cucumber
gaaaatgttcattgagagctttaaggttgagagtccaaatgtggagtacactgcgaatgagattctttctgtgtacaactatgaaacaacagaacttgttcatgagcttaagaatggtagctatcaatggacggtgaagcccaagactgtcaaataccaattcaaaactcaaactcatgtcccaaagctaggggttatgcttgttggatggggtgggaataatggttgtactcttacagggggggttattgccaatcgagaagggatttcctgggcaactaaggataaagtacaacaagccaattattttgggtcattgactcaggcttcgtccatccgggtgggttcttacaatggagaggagatctatgccccatttaaaagcctgcttcctatggttaatccagatgacattgtgtttggaggttgggacattagtgacatgaacttggcagatgccatggcaagggccaaggtgtttgatattgacctacaaaagcagttgagaccctacatggaatccatggtcccacttcctgggatctacgaccctgatttcattgctgctaatcaaggttctcgagctaacaatgtgattaaaggaaccaagagagaacaagtccaacaaatcataagtgatatcaaggagtttaaggagaagagtaaagtggatgaagttgttgtgctttggaccgccaacacagagagatacagcaatgtagttgtgggactgaatgacacaatggagagccttttagcttctttggacaagaatgaggctgaaatatctccttctaccctgtatgccatagcctgtgttcttgagaatgttccttttatcaatggaagcccacaaaacaccttcgtcccagggttgattgatttggctattaggagaaacagtttgataggaggagatgactttaagagtggtcaaaccaagatgaaatctgtcctagtagattttctagttggtgctggtattaagccaacttcaattgtgagctacaatcatcttggaaacaatgatggaatgaatctctctgctccacaaaccttccgctcgaaagaaatatcaaagagcaatgtggtcgacgacatggtctcgagcaatggcatcttgtacgaaccaggggagcatccagaccatgttgtagtgatcaagtatgtgccatatgttggagatagcaagagagccatggatgagtacacgtcagagatattcatgggcggaaagagcaccattgtactgcacaacacatgcgaggactccctcttggctgctcccattatccttgatttggttctacttgctgagctaagcactcgcatccaactcaaggctgaaggagaggggaagtttcattctttccacccagtggctacaatactgagctaccttaccaaggcacctcttgttcccccaggcacaccagttgtgaatgcactatcaaagcaaagggcaatgttagagaacattctgagggcctgtgttgggcttgctcctgagaataatatgatattggaatacaagtgatcgaaggaggaagactgatcttgagagattctgcctttttctgctttacaagtttgagtttgatgtaattgttctttggagaacctctcagctatgttcatttctttt

SEQ ID NO: 429 - DNA, 1826 bp, Vinca
ttttcagtctctctccgctaagaaattttcttggggtttttttgggtgatatttaaggatgtttattgagagctttaaggttgacagtgccaatgttaagtacacagaaactgaaatccattctgtgtataactatgaaactactgaacttgttcatgagaacagagatggtacttatcaatggattatcaagcccaaaactgttaaatacgaattcaagactgatacccgtgtccccaaacttggggttatgcttgttgggtggggagggaacaatggttcaactctcactgctggtgtcattgcaaacagagagggaatttcatgggcaactaaagataaagtgcaaagggcaaattactttggttccttgactcaggcatcaactattcgagttgggtcctttaatggggaagagatctatgcccctttcaagagcttgctccccatggtcaaccctgatgatattgtgtttggagggtgggacatcagtaatttgaacttggcagatgccatggctaggggaaaggtcttagatattgatcttcagaagcaattgaggccctacatggaatccatggtccctcttcctggtatctatgagcctgatttcattgctgccaaccaagggtcccgtgccaacaatgtcctcaaaggaaccaagaaagaacaaatgcaacaaatcatcaaggatattaaggagtttaaggagaagaacaaggttgataaggttgtggttctttggacagcaaacacagaaagatatagtaatgtgattgttggtcttaatgacacagtggaaaacctatttgcttctttggatagaaatgaagctgagatttctccatccactttgtatgctatggcttgtgttcttgaaaatgtgcctttcattaatggcagcccacagaacacttttgtcccaggattgattgatttggctattaagagaaacagcttaattggaggagatgacttcaagagtggtcagactaagatgaaatcagttcttgttgatttccttgttggggctggtatcaagccaacttctattgtgagctacaaccatttaggaaacaatgatggaatgaatctttcagctcctcaaactttccggtccaaggagatttccaaaagtaatgtggtggatgatatggtagctagcaatgctatcctctacgaaccgggcgagcatccggaccacgtagtcgtgatcaagtatgtcccatatgttggagatagcaagagggctatggatgagtacacatctgagatattcatgggtggaagaaacactatagtcttgcacaacacttgtgaggactctcttttggctgctccaattatcttggacttagtcctccttgctgaactcagcactcgcattcagctcaaatctgaagctgagggcaagttccattcatttcatcctgtggctacaatcctcagttacctcagcaaggcccctcttgtaccaccaggcacaccagtggtgaatgcactgtcaaagcagagggcaatgctggagaatataatgagggcttgtgttggacttgcaccagagaacaatatgattctggagtacaagtgaagcagatgatgaagacgaagacgaagaagaatagcaagataaattaatcggaaaaatgtggttttaatcttgtttggtaccttgtttaaaggattaatttttcccttatttctcttagctataagatgtaatattaattgtggtccataaatattttgtaatgtgggaatattgtcttgttcttgtgtatctttgttggtaatttatgtgtattctggttgcgttgatatttccc

SEQ ID NO: 430 - DNA, 1977 bp, Watermelon
aagcaatggatcacatacattacagcagcctgaggtagagagagagccttgtttggttgagtggagaggtttccagtccattttcttcttgcatttctgatagaggaaaaaagaaagatgttcattgagagctttaaggttgagagtcccaatgtgaagtacactgcgaatgagattcattctgtgtataactatgaaacaacagaacttgttcatgagcttaagaatggtagctatcaatggacggtgaaacccaagactgtcaaatatgaattcaacactcaaacccatgtcccaaaactaggggttatgctcgttggatggggtggaaataatggttctactcttactgggggagttattgccaatagagaagggatctcctgggcaactaaggataaagttcaacaagccaattattttgggtcattgactcaggcttcatccatccgggtgggttcttacaatggagaggagatatatgccccatttaaaagcctgcttcctatggttaatccagatgacattgtgtttggagggtgggacattagtgatatgaacttggcagatgccatggcaagggccaaggtgtttgatattgacctgcaaaagcagttgaggccctacatggaatccatggtcccactccctgggatctatgaccctgatttcattgctgctaatcaaggttcacgagctaacaatgtgattaaaggaaccaagagagaacaagttcaacaagtcataaatgatatcaaggagtttaaggagaagaataaagtggataaagttgttgtgctttggactgccaacacagagagatatagtaatgtagttgtggggctaaatgacacaatggagagcctcttagattcattggacaagaatgaggctgaaatatctccttctaccttgtatgcaatagcctgtgttcttgagaatgtcccttttatcaacggaagcccacagaacaccttcgtcccagggttgattgatttggctatcaggaggaacagtttgataggaggagatgactttaagagtggtcaaaccaagatgaaatctgtcctagtagattttctagttggtgctggtattaagccaacttcaattgtgagctataaccatcttggaaacaatgatggaatgaatctctctgccccacaaaccttccgctccaaagaaatatcgaagagcaatgtggtggatgacatggtctcgagcaatggtattttgtacgaacctggggagcatccagaccatgttgtagtgatcaagtatgtgccatacgttggagacagcaaaagagccatggatgagtacacatcagagatattcatgggtggaaagagcaccatagtactgcacaacacatgcgaggactccctcttggctgctcccattatccttgatttggttctgcttgctgagctaagtactcgcatccagctcaagactgaaggagagggtaagtttcattctttccatccagtggctacaatactgagctacctcaccaaggcacctcttgttcctccaggcacaccagttgtgaatgcactatcaaagcaaagggcgatgttagagaacatattgagggcgtgtgttgggcttgctcctgagaataatatgatattggaatacaagtgatggaagaaggaagactcttgagaaattctgcctttttctgctttccaagtttgagtttgatgtaattgttctttgaagaagctctcagctatgtgcattttttccctttttctttttcttttgggtgtttttctagagaatgaagcttctgtgaaggctgttgtgttgactgattcaacagcatcccgtaatgggaatagataattagtttagtgggttcaggctaagctactgttcagtttgcaaactaatggtacatatattttcaatctgaacttctaaacttttcaatacaatataaaacaatattctagtactcataagttg

SEQ ID NO: 431 - DNA, 2039 bp, Castorbean
gtggccatggccgggcacatagggttgagattggaagcaaattccggttcttctttgcttttcgttcttgtttttgttttgtgagcttgcaatctcaatctttgtattcaaattcttttgaaaatgtttattgagaaatttaaggttgagagtcctaatgttaagtactcagaggatgagattcactctgtgtataactatgaaacaactgagcttgttcatgagaacagaaatggtacctatcaatggattgtaaaacccaaaacagtccaatatgaattcaagactgatgtccatgttcctaaattaggggttatgcttgtgggttggggtggaaacaatggttctactctcaccggtggtgttatagcgaacagagaaggaatctcctgggctaccaaagacaaagtgcagcaagcaaattactttggctcgctcactcaagcttcatcaattcgagttgggtcttttaatggagaagagatttatgctccattcaagagccttctccccatggtgaatccagatgacattgtgtttggtgggtgggacataagtgacatgaacttggctgatgctatggccagggctaaggttctggatattgatcttcagaaacaattgcggccctacatggaatctatggttccactccctggaatctatgaccctgattttattgctgctaatcaaggatcgcgtgccaacaacgtgattaaaggcactaaaaaagaacagatggaacaaattgtcaaggatattagggagtttaaggagaaaaccaaagtggataaagtcgttgtgctttggactgccaacactgagaggtacagtaatgttgttgtggggctaaatgacactatggagagcctcttggcttctttggagagaaatgaagctgagatatctccctcaaccttgtatgctttggcttgtatctttgaaaatgttcctttcattaatggaagcccacagaacacttttgttcctggggttattgatttggctattaaggggaacagtttgatcggcggggatgacttcaagagtggtcagaccaagatgaaatccgtactggttgatttccttgttggggctggtattaagccaacatcaatagtgagttacaaccatttaggaaacaatgatggcatgaacctttcagcaccgcaaactttccgttccaaagaaatatccaaaagcaatgttgttgatgacatggtctctagcaatggtatcctctatgaacctggtgaacatcctgaccatgttgtggtcatcaagtacgtgccatatgtgggggatagcaagagagctatggatgagtacacttcagagattttcatgggtggcaaaagcaccatagtcctgcacaacacttgcgaggattccctcttggctgcacccattattttggatttggtcctacttgctgaactcagcaccaggatccagcttaaagctgaaggagagggaaagttccattccttccatcctgtggctaccattctcagctacctcaccaaggctcctcttgttccaccaggcaccccagtggtgaatgcactgtcaaagcagcgtgcaatgctggagaacatattgagagcttgtgttggtttggctcctgagaacaacatgattttggaatacaagtgaaacatacaatgaagaagtaaaaaaaaaaaagtggaagaagaagaagattggtagacccatccaggggttgccaaaagaatgtttatctttcttttgtctctttctttcaccgagtatgtggtcaatgtgcttcctaaatgtaatattcgtatcatatgccattaccctttactatagtatggattttctattaatttatcgttattgaatggtgctccatgtatagctccgtttgctttgactggtcctttatcaactcttttatcttgaaatagatggaaatgtgcaacttgttttcttttctggtttaactgagctgtgtgtttgcttctcatctaatttgcatgaaagcaactcctcatttctctctggatgaatgcaaa

SEQ ID NO: 432 - DNA, 1889 bp, Cotton
tttttttataaaaagttcagcaaaaatgtttattgagaattttaaggtggagagccccaatgtgaagtacacagagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggtggtgttatagctaacaaagagggtatctcttgggctactaaggacaaggtacaacaggctaattactttggttcattgactcaagcatcaacgatccgaattgggtcttacaatggagaagagatttatgctccatttaagagtcttcttcctatggtgaacccaaatgatattgtgtttggaggatgggacattagtgacatgaacctagctgatgcaatggctagggccaaggttttcgacattgatctgcaaaagcaactgagaccctacatggaatccatggtcccactccctggaatctacgatcctgatttcattgctgctaaccaaggtgaacgtgccaacaatgttatcaaggggaccaagaaagaacaagttcagcaggtcatcaaagacatcaaggagttcaaagagaaaaacaaggtggacaaggttgttgtactctggactgcaaacactgagaggtacagcaatgtcatcgtggggctaaatgacaccgtggaaagccttatggcttctttggagaagaatgaatcagagatttctccttccactttgtatgctattgcttgtgttcttgaaaatgttcctttcatcaatggcagcccacaaaacacctttgttccagggttgattgatttggctattcaaaggaactgtctgattggaggagatgacttcaagagtggccagaccaagatgaaatctgtcctcgtggatttccttgttggggctgggatcaagccaacatcgatagtgagttacaaccatctgggaaataatgatggcatgaatctatcggcaccccaaaccttccgttccaaggagatctcaaagagcaatgttgttgatgacatggtttcaagcaatggaatcctgtatgagcctggtgaacatcctgatcatgttgtggtcatcaagtatgtgccatatgtgggagacagcaagagagccatggatgagtatacatcagagatattcatgggaggcaagaacaccattgtgttgcacaacacatgtgaggattccctgttggctgctcccattatcctagatttggttctccttgctgagcttagcaccaggatccagttcaaggctgatggagagggcaagttccactctttccatcctgtggctacaatcctcagttacctcaccaaagcccctcttgttccaccaggcacaccggtggtgaacgcactgtccaagcagcgtgcaatgctggagaacatactaagggccagcattggcttggctcctgaaaacaacatgattttggaatacaagtgaagaagttgaggagagaaaagtggaacaaagctttggttcttagaactttaggaccattttccctttctctgtcgtattcataaaagctgtggttactgtagtcacagattgtaacggttgtatgatggtttatgctttggtatattatgcttctttttttctcatttattttccgatggcgctcatgtttgtagctcactcttgaaccaagcaccccttttgtggaaatagatatgataatatgaattttggtaaccgtgttatcttttattgctcttatcatatggtttgatacaaggccaagagtcactttggattgaaacaaaaaaaa

SEQ ID NO: 433 - DNA, 1911 bp, Oak
tggtgttaggattgagagagagaggaaagagaggcacacaaaactttctttttttcttctctacttcgtttataacaaagtccctttggttcacttttgtttagttagttcacctccatttaacccaaaaaaaaaaaaaacatgttcattgagagctttaaggtagagagtcctaatgttaagtacacagagaatgagattcactctgtgtacaattacgacaccaccgagcttgttcatgagaacaggaatgggacttatcagtggattgtcaagcccaaaactgtaaaatacgaattcaagactgatatccatgtccctaaacttggggttatgcttgtgggatggggaggaaacaacggttcaactctcaccgctggtgtaattgccaatcgagaaggaatctcctgggccaccaaggacaaagtgcaacaagccaattattttggctcactgacccaagcctcaacaattcgtgttgggtctttccatggagaggagatctatgcgcctttcaagagcttgctcccaatggtgaacccagatgacattgtgtttgggggttgggatatcagtgacatgaacctagcagatgctatggccagggccaaggttctggacattgatttgcagaagcagttgaggccctacatggagtctatggtcccactccctggaatcttcgaccctgatttcattgctgctaaccaaggttcacgtgccaacaacgtcatcaaagggaccaagaaagaacaagtccaacaaattattaaagatattagggagttcaaggaggcaaccaaggtagataaggtggtagtgctgtggactgctaacacagagaggtacagtaacgtgattgtggggctaaatgacacagaggagagcctcttggcttctgtggagaagaatgaggctgagatatctccttccaccttgtatgccttggcttgtgtttatgaaaatattcctttcatcaatggaagccctcagaacacttttgttccaggactgattgacttggctattaagaggaacagtttgattggtggggatgacttcaaaagtggtcagaccaagatgaaatctgtgttggtagatttccttgttggggctggtattaagccaacatccatagtgagctacaaccacttgggaaacaacgacggcatgaacctctctgccccacaaaccttccgctccaaagaaatctccaaaagcaacgttgttgatgacatggtctctagcaacgctatcctttatgagcctggggagcatcctgaccatgtcgtggtcatcaagtatgtgccatacgtgggggatagcaagagagccatggatgagtacacctcagaaatattcatgggagggacgaataccatagtgttgcacaacacttgcgaggactccttgttggctgcacccatcatcctagatttggtgcttcttgctgagctcagctcccgtatccagctcaaagcggaaggagagggcaagtttcactcattccaccctgtggctactattctcagctaccttaccaaggcccctcttgttccaccgggcacgcctgtggtgaatgcacttgcgaagcagcgagctatgcttgagaacattctgagggcttgcgttggattggctccagagaacaacatgattttggaatataagtgaataagaggagggaagattggctctaatagtattcaagaattatccccttaagtctatgtctcatgttaatgttggtctgagagggttgttagtagcattctatgtttaaagtttccagtttatgttttgtaaagcttctcaattgtgattctgtttgctcagttcatttctggaatggaactagataattttataaaaggtttagtataatatatcctgcagaattgtctagtgacc

SEQ ID NO: 434 - DNA, 1934 bp, Pepper
gcacgagggagctcttggcctttaagaatatatattcttcttagttacaaaagttctattttccttgcaaaacagtttccctctttttcgaatttttgtctcgtgttgtgaaaatgtttattgaaaactttaaggttgagagccccaatgttaagtacacagagagtgtaattcactctgtgtatgattatcaaaccactgagttggttcatgaggaaaaaaacgggacatatcaatggaccgtcaagcccaaaacagtcaaatacgaattcaagactgatgttcatgttccaaaattaggggttatgcttgttggatggggtggaaataatggttcaaccttgactggaggagttatcgctaatagagaaggaatttcatgggccaccaaggataaggtgcagcaagccaattactttggttctcttacacaagcgtctactattcgagttgggtcttttaatggagaggagatctatgctccctttaagagcatccttcccatggtcaacccggatgatgtagtgtttggaggatgggacatcagcaacatgaatttagcagacgccatggcaagggctaaggtttttgacattgatctacaaaagcagttgaggccctacatggaatccatggtcccactccctggtatctatgaccctgatttcattgctgctaaccaaggttcacgtgcaaacaatgtcgtcaaaggaacaaagaaagaacagattgatcaaatcattaaggatattagggagtttaaggagaagaacaatgtggacaaggtggtggttctgtggactgccaacactgaaagatatagcaatgtggctgttggtcttaatgacaccatggaaaacctctttactgctgtagatagaaatgaggctgaaatatctccttccaccttgtatgctattgcttgtattcttgaaaatgtgcccttcatcaatggaagcccacaaaacacttttgtaccaggcttcattgatttggccatcaaaaggaacactttgattggtggtgatgactttaagagtggtcaaaccaagatgaagtcggtgcttgttgatttccttgttggagctggcattaagccaacatcaattgtgagctacaaccatttgggtaacaatgatggaatgaatctgtctgcccctcaaacttttcgctcaaaggagatctcaaaaagcaatgttgttgatgacatggtttctagcaatgccatcctttatgagcctggagagcaccctgaccatgttgttgtgattaagtatgtaccctacgtgggagacagcaagagggcaatggatgagtacacatcagagattttcatgggtggaaagaacaccattgttttgcacaatacctgtgaggactctcttttggctgctccaattatcttggatttggtcctccttgctgaactcagtactcgcattcagctcaaagccgagggagagggtaagttccactccttccaccccgtggctaccatcctcagctatcttaccaaggctcctctggtaccacctggtacaccagtggtgaatgccctttcaaagcagagggcaatgcttgagaacatattgagggcttgtgttggactggcaccagagaacaacatgatcttggaatataaatgaagatgatgagatctcctaagaagtaaaagggctgaagaagctgtgcagcagtaggaaccatattgtcgttcttttcttttacttttgttatcttttccttttcattagtgtactacaattagctaaatatcagcaacccttcgaggtatatctgtttaatgacgggccaagttaaatgtcattataatttctttgccgtttacaatgtgtatcagcgttgtcttaagctcatttagagccaacaacgcctttctctactggaaatacaatgtgtactcttaaaaaaaa

SEQ ID NO: 435 - DNA, 1994 bp, Tabernaemontana
tttgagaatttgagaggttttttcccattttttcaatctctctccgcttctttctagtgttgacgtttgtaatttgttgagttttttgtttgtgaaatttaaagatgttcatcgaaagctttaaggttgacagtgccaatgtcaagtactcagagagtgaaattcactctatctataactatgaaaccaccgaacttgttcatgagaacagggatggtgcttatcagtggattgtcaagcccaaaactgtcaaatacgagttcaagactgatactcgtgtccccaagcttggggttatgcttgttgggtggggagggaacaatggctcaactctcaccggtggcgtcatttcaaaccgggaaggaatttcatgggcaaccaaagacaaggtgcagcaagccaattactttggttcccttactcaggcatcaacaatccgagttgggtccttcaatggggaagagatctatgcccccttcaagagcctactccccatggtcaaccctgatgatattgtgtttggagggtgggacatcagcaacatgaacttggcagacgccatggctagggctaaggtcttagatattgatcttcagaagcagttgaggccctacatggaatccatggtccctctccctggtatctatgaacctgatttcattgctgccaaccaaggggcccgtgccaacaacgtcataaaaggaaccaagaaagaacaaatgcaacaaatcatcaaggatattcaggagtttaaggagaagaacaaggtagacaaggtagtggttctgtggactgcaaacacagagagatacagtaatgtggttgttggacttaatgacaccatggaaaacctttttgctgctttggatagaaatgaggctgagatttctccgtccactttgtatgccatagcttgtgttcttgaaaacgtgcctttcatcaatggcagcccacagaacacttttgttccaggcttgattgatttggctatcaagaggaacagtttaatcggtggggatgatttcaagagtggtcagaccaagatgaaatcagtgcttgttgatttccttgttggagctggtatcaagccaacttccatagtgagctacaaccatttgggaaacaatgatggaatgaatctttcagcccctcaaactttccgctccaaggagatttccaaaagtaatgtggtggatgacatggtagccagtaatgctatactctatgaacccggcgagcatccagaccatgtggttgttatcaagtatgtgccttatgttggagatagcaagagggctatggatgagtacacatcagagatattcatgggtggaaagagcaccattgtgctgcacaacacttgcgaagactctctcttggcggcaccgatcatcttagacttggtcctccttgcagaactcagcagtcgcattcagctcaagtctgaagctgaggccaagttccactcattccaccctgtggctaccatcctcagctacctcaccaaggcccctcttgtacccccaggcacgcctgtggtgaacgcgcttgcgaaacagagggcaatgctggagaacatcctgagggcttgtgttggacttgcaccagagaacaatatgattttggagtacaagtgaagacgatgaaggagaatagcatgacaaattaataggaaaatgtagtttagtatcttgttcagaggaccattttttcctctattattgcttctttttgtggtgtcatatgtgtccatttctctggaagatgtaatattattcgtgatggtccataaccactgtattgtggaatattgttgtgtgtgtgtattcttgttggcaattgatgtgtatccctggttgcattgactcttctcttagagcattgcattcccttttctaatggaagtagaatgttgaataatttcaagactgtaattttttgttttacttattgttaaagtgcctataagagactcgctcgtaactcataattgt

SEQ ID NO: 436 - DNA, 1927 bp, Cotton
ggcaaaagaaaaataaaaacagtttcatttccattctaagtttgtgttttgtatttgccttttgtgggttttttttaaaaaaaatttcagcaaaaatgtttattgagagttttaaggtagagagccccaatgtgaagtacacggagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggaggtgttatagctaacaaagagggtatctcttgggctactaaggacaaggtacaacaggctaattactttggttcattgactcaagcatcaacgatccgagttgggtcctacaatggagaagagatttatgctccatttaagagtcttcttcctatggtgaacccaaatgatattgtgtttggaggatgggacattagtgacatgaacctagctgatgcaatggctagggccaaggttttcgacattgatctgcaaaagcaactgagaccctacatggaatccatggtcccactccctggaatctacgatcctgatttcattgctgctaaccaaggtgaacgtgccaataatgtcatgaaggggaccaagaaagaacaagttcagcaggtcatcaaagacatcagggagttcaaagagaaaaacaaggtggacaaggttgttgtactctggactgcaaacactgagaggtacagcaatgtcattgtggggctaaatgacaccgtggaaagccttatggcttctttggagaagaatgaatcagagatttctccttccactttgtatgctattgcttgtgttcttgaaaatgttcctttcatcaatggcagcccacaaaacacctttgttccagggttgattgatttggctattcaaaggaactgtctgattggaggagatgacttcaagagtggccagaccaagatgaaatctgtcctcgtggatttccttgttggggctggtatcaagccaacatcgatagtgagttacaaccatctgggaaataatgatggcatgaatctgtcagcaccccaaaccttccgttccaaggagatctcaaagagcaatgttgttgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttccatcctgtggctacaatcctcagttacctcaccaaagcccctcttgttccaccaggcacaccggtggtgaacgcactgtccaagcagcgtgcaatgctggagaacatactaagggccagcattggcttggctcctgaaaacaacatgattttggaatacaagtgaaaaagttgagagaaaagtggaacaaagctttggttcttagaactttaggaccattttccctttctctgtcgttttcataaaagctgtggttactgttgtcacagattgtaacggttgtatgatggtttatgctatgcttctttttttctcatttattttcaagtggcgctcatgtttgtagctcactcttgagccaagcacctcttttgtggaaatagatatgatagtatgaattttcgtaaaaaaaaaaaaaaaaaactcgtgccgattatatggatccagtaggtgaccgcagcgcg

SEQ ID NO: 437 - DNA, 1795 bp, Cotton
aaaaaaaattcagcaaaaatgtttattgagagttttaaggtagagagccccaatgtgaagtacacggagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggaggtgttatagctaacaaagagggtatctcttgggctactaaggacaaggtacaacaggctaattactttggttcattgactcaagcatcaacgatccgagttgggtcctacaatggagaagagatttatgctccatttaagagtcttcttcctatggtgaacccaaatgatattgtgtttggaggatgggacattagtgacatgaacctagctgatgcaatggctagggccaaggttttcgacattgatctgcaaaagcaactgagaccctacatggaatccatggtcccactccctggaatctacgatcctgatttcattgctgctaaccaaggtgaacgtgccaataatgtcatgaaggggaccaagaaagaacaagttcagcaggtcatcaaagacatcagggagttcaaagagaaaaacaaggtggacaaggttgttgtactctggactgcaaacactgagaggtacagcaatgtcattgtggggctaaatgacaccgtggaaagccttatggcttctttggagaagaatgaatcagagatttctccttccactttgtatgctattgcttgtgttcttgaaaatgttcctttcatcaatggcagcccacaaaacacctttgttccagggttgattgatttggctattcaaaggaactgtctgattggaggagatgacttcaagagtggccagaccaagatgaaatctgtcctcgtggatttccttgttggggctggtatcaagccaacatcgatagtgagttacaaccatctgggaaataatgatggcatgaatctgtcagcaccccaaaccttccgttccaaggagatctcaaagagcaatgttgttgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttccatcctgtggctacaatcctcagttacctcaccaaagcccctcttgttccaccaggcacaccggtggtgaacgcactgtccaagcagcgtgcaatgctggagaacatactaagggccagcattggcttggctcctgaaaacaacatgattttggaatacaagtgaagaagttgaggagagaaaagtggaacaaagctttggttcttagaactttaggaccattttccctttctctgtcgtattcataaaagctgtggttactgtagtcacagattgtaacggttgtatgatggtttatgctttggtatattatgcttctttttttctcatttattttccgatggcgctcatgtttgtagctcactcttgaaccaagcaccccttttgtggaaatagatatgataatatg

SEQ ID NO: 438 - DNA, 1996 bp, Gossypium raimondii
taaataaacctcctagtcccaagctttgaagcacaaaattctggggcaaaagagaaataaaaacagtttcatttccattctaagtttgtgtttttgatttgccttttgtgggttttttttaaaaaaaaattcagcaaaaatgtttattgagagttttaaggtagagagccccaatgtgaagtacacggagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggaggtgttatagctaacaaagagggtatctcttgggctactaaggacaaggtacaacaggctaattactttggttcattgactcaagcatcaacgatccgagttgggtcttacaatggagaagagatttatgctccatttaagagtcttcttcctatggtgaacccaaatgatattgtgtttggaggatgggacattagtgacatgaacctagctgatgcaatggctagggccaaggttttcgacattgatctgcaaaagcaactgagaccctacatggaatccatggtcccactccctggaatctacgatcctgatttcattgctgctaaccaaggtgaacgtgccaataatgtcatgaaggggaccaagaaagaacaagttcagcaggtcatcaaagacatcagggagttcaaagagaaaaacaaggtggacaaggttgttgtactctggactgcaaacactgagaggtacagcaatgtcattgtggggctaaatgacaccgtggaaagccttatggcttctttggagaagaatgaatcagagatttctccttccactttgtatgctattgcttgtgttcttgaaaatgttcctttcatcaatggcagcccacaaaacacctttgttccagggttgattgatttggctattcaaaggaactgtctgattggaggagatgacttcaagagtggccagaccaagatgaaatctgtcctcgtggatttccttgttggggctggtatcaagccaacatcgatagtgagttacaaccatctgggaaataatgatggcatgaatctgtcagcaccccaaaccttccgttccaaggagatctcaaagagcaatgttgttgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttccatcctgtggctacaatcctcagttacctcaccaaagcccctcttgttccaccaggcacaccggtggtgaacgcactgtccaagcagcgtgcaatgctggagaacatactaagggccagcattggcttggctcctgaaaacaacatgattttggaatacaagtgaaaaagttgagagaaaagtggaacaaagctttggttcttagaactttaggaccattttccctttctctgtcgttttcataaaagctgtggttactgttgtcacagattgtaacggttgtatgatggtttatgcttatgcttctttttttctcatttattttcaagtggcgctcatgtttgtagctcactcttgagccaagcacctcttttgtggaaatagatatgatagtatgaattttcgtaactggacaatcttttattgctcttatcatatggtttgatacaaggccaagagtcactttggattgaaaattgacattaataa

SEQ ID NO: 439 - DNA, 1943 bp, Tomato
aaacagtacaagtggagctcttagccttaaaagtgtcttcttctccattttttttctgtcaacacacaaaaaaaaagtttcaaaagttttgtgtttgtgagtaaaaatgtttattgagaactttaaggttgagagccccaatgttaagtacacagagagtgagattcactctgtgtatgattatcaaacaactgagttggttcatgaggaaaaaaatgggacatttcaatggactgtaaagccaaaaactgtcaaatatgaattcaaaactgatgttcatgttccaaaattaggagttatgcttgttggatggggtggaaacaatggttcagccttgaccggaggtgttattgctaatagagaaggaatttcatgggctaccaaggataaggtgcagcaagccaattactttggttctcttacacaggcctctactattcgagttgggtctttcaatggagaggagatctatgctccctttaagagcatacttcccatggtcaatccagatgatgtagtttttggaggatgggacatcagcaacatgaatttggcagatgccatggcaagagctaaagtttttgacattgatcttcaaatgcaactgaggccgtacatggaatccatggtcccactgcctggtatctatgaccctgatttcattgctgcaaaccaaggctcacgtgctaacaatgtcatcaaaggaaccaagaaagaacaaattgatcaaattattaaggatattagggagtttaaggagaacaacaaagtggacagggtggtggtcctgtggactgccaacactgaaagatacagcagtgtggctgttggctttaatgataccatggaaaacctctttgcttctgtggatagaaatgaggctgaaatatctccttccaccttgtatgctattgcttgtattcttgaaaatgtacccttcatcaatggaagcccacaaaatacttttgtcccaggcctcattgatttggccatcaagaggaacactttgattggtggtgatgactttaagagtggtcaaaccaagatgaagtcagtgctggttgatttccttgttggagctggtattaagccaacatcaatcgtgagctacaaccatttgggtaacaatgatggaatgaatctgtctgcccctcaaactttccgttcaaaggagatctcgaaaagcaacgttgtcgatgacatggtttctagtaacgccatcctttatgagcctggagagcatcctgaccatgttgttgtgattaagtacgtaccatatgtgggagatagcaagagggcaatggatgagtacacatcagagattttcatgggtggaaggaacaccattgtattgcacaatacctgtgaggattctcttttggctgctccaattatcttggatttagtgctcctggctgaactcagtacccgcattcagctcaaagctgaaggagagggtaagttccactccttccatcccgtggcgaccatcctcagttatcttaccaaggctcctttggtaccaccaggtacaccagtggtgaatgccctttcaaagcagagggcaatgctcgagaacatattgagggcttgtgttggactggcaccagagaacaacatgatcttggaatacaaatgaaaaactcataagatgtgaaaggactgaagaagttgtgtagcagaagaaccatgttgtctttctttacttttatttttgtaatctttttcttatcattagtactactataattagctaaatctcagccaacccttagaggtatagctgttgtttgatgatgtgctaagttgaatgtcattgtgatttctttgttgtctttttgtattagcccttcattttcaagatgtattatcggtgttgtcttagctctttagagcgagcaacgcctttctctaccggaaatacaacatattgtcttgctcta

SEQ ID NO: 440 - DNA, 1950 bp, Solanum phureja
aaacagtacaagtggagctcttagccttaaagaatatacttttgagtgtcttctccatttttttttggtcaaaaaaaaaaaaaagtttcacttttttgtgtttgtgagtgaaaatgtttattgagaactttaaggttgagagccccaatgttaagtacacagagagtgagattcactctgtgtatgattatcaaacaactgagttagttcatgaggaaaaaaatgggacatttcaatggactgttaagccaaaaactgttaaatatgaattcaagactgatgttcatgttccaaaattaggggttatgcttgttggatggggtggaaacaatggttcagccttgactggaggtgttattgctaacagagaaggaatttcatgggctaccaaggataaagtgcagcaagccaattactttggctctcttacacaggcctctactattcgagttggttccttcaatggagaggagatctatgccccctttaagagcatacttcccatggtcaatccagatgatgtagtgtttggaggatgggacatcagcaacatgaatttggcagatgccatggcaagggctaaagtttttgacattgatcttcaaaagcagctgaggccctacatggaatccatggtcccactgcctggtatctatgaccctgatttcattgctgcaaaccaaggctcacgtgctaacaatgtcattaaaggaaccaagaaagaacaaattgatcaaatcattaaggatattagggagtttaaggagaacaacaaagtggacaaggtggtggttttgtggactgctaacactgaaagatacagcagtgtggctgttggccttaattggccttaatgataccatggaaaacctctttgcttctgtggatagaaatgaggctgaaatatctccttccaccttgtatgctattgcttgtattcttgaaaatgtgcccttcatcaatggaagcccacaaaacacttttgtcccaggcctcattgatttggccatcaagaggaacactttgattggtggtgatgactttaagagtggtcaaaccaagatgaagtcagtgctggttgatttccttgttggagctggtattaagccaacatcaattgtgagctacaaccatttgggtaacaatgatggaatgaatctgtcggcccctcagactttccgctcaaaggagatctcgaaaagcaatgttgtcgatgacatggtttctagtaatgccatcctttatgagcctggagagcaccctgaccatgttgttgtgattaagtatgtaccatatgtgggagatagcaagagggcaatggatgagtacacatcagagattttcatgggtggaaggaacaccattgtattgcacaatacctgtgaggattctcttttggctgctccaattatcttggatttggtcctccttgctgaactcagcacccgcattcagcttaaagctgaaggagagggtaagttccactccttccatcccgtggcgaccatcctcagctatcttaccaaggctcctctggtaccaccaggtacaccagtggtgaatgccctttcaaagcagagggcaatgcttgagaacatattgagggcttgtgttggactggcaccagagaacaacatgatattggaatacaaatgaagatctcataagaagtgaaaggactcaagaagccgtgtagcagaagaaccatgttgtctttctttacttttatttttgtaatcttttgtctcatcattagtactataattagctaaatctcagccaacccttggaggtatagctgttgtttaatggcgggctaagttgaatgtcattatgatttctttgtgtattaggccttcattttgaagatgtattatcagtgttgtcttagctctttagagccagcaacgccttttctctaccggaaatacaatgtatagtcttactcta

SEQ ID NO: 441 - DNA, 1920 bp, Chestnut
aagagagacacgtacaaaactttctttctttctttttcttctcaacttcgtttataacaaagtcccttaggttcacttttgtttagttagttcacttccatttaacaaaaaaaaaagaaaacatgttcattgagagcttcaaggtagacagtcctaatgttaagtacacagagaatgagattcattctctgtacaattatgacaccactgagcttgttcatgagaacaggaatgggacttaccagtggattgtcaagcccaaaactgtaaaatacgaattcaagactgatatccatgtcccaaaacttggggttatgcttgtgggatggggaggaaacaacggttcaactctcaccgctggtgtaattgccaatcgagaaggaatctcctgggccaccaaggacaaagtgcaacaagccaattattttggctcactgacccaagcctcaacaattcgtgttgggtctttccatggtgaggagatctatgctcctttcaagagcttgctcccaatggtgaacccagatgacattgtgtttgggggttgggatatcagtgacatgaacctagcagatgctatggctagggccaaggtcctggacattgatttgcagaagcaattgaggccctacatggagtctatggtcccactccctggaatcttcgaccctgatttcattgctgctaaccaaggctcacgtgccaacaacgtgatcaaagggaccaagaaagaacaagtccaacaaattattaaagatattagggagttcaaggaggcaaataaggtagataaggtggtagtgctgtggaccgctaacacagagaggtacagtaatgtgattgtggggctaaatgacacagaagagaacctcttggcttctgtggagaagaatgaggctgagatatctccttccaccttgtatgccctggcttgtgtttatgaaaatattcctttcatcaatggaagccctcagaacacttttgttccaggactgattgacttggctattaagaggaacagtttgattggtggggatgacttcaaaagtggtcagaccaagatgaaatccgtgttggtagatttccttgttggggctggtattaagccaacatccatagtgagctacaaccacttgggaaacaatgacggcatgaacctctctgccccacaaaccttccgctccaaagaaatctccaaaagcaacgttgttgatgacatggtctctagcaacgctatcctctatgagcctggggagcatcctgaccatgtcgtggtcatcaagtatgtgccatacgtgggggatagcaagagagccatggatgagtacacctcagaaatattcatgggagggacgaataccatagtgttgcacaacacttgcgaggactccttgttggctgcacccatcatcctagatttggtgcttcttgctgaactcagctcccgtatccagctcaaagctgaaggagagggcaagtttcactcattccaccctgtggctactattctcagctacctcaccaaggcccctcttgttccaccgggcacgcctgtggtgaatgcacttgcaaagcagcgagctatgcttgagaacattctgagggcttgcgttggattggctccagagaacaacatgattttggaatataagtgaataagaggaagggattgatgggagattggctctaatagtattcaggaattatcccctaacgtctatatgtctcatgaatgttggtgtgatagggttgttagtagcattctatgtttaaagtttccagtttatgttttgtaaagcttctcaattgtgattctgttgcttcagttcatttctggaacaagcaaagcaacccttttgtgttggaactagaaaattttataaaaggtttaatataatatatcctgctgaattgtctagt

SEQ ID NO: 442 - DNA, 1862 bp, Flaveria
aatatagatccctttgagtttgttctttgatcatcagccaatatgttcatcgagagctttaaggtcgaaagccccaacgtcaagtacactgatgatgaaattcactctctgtacaattacgacaccactgagctcgttcacgaggagaaaaacggtgcttatcaatgggttgttaagcctaaaaccgtcaaatacgagttcaaaactcaaactcgtgtccctaaactaggggttatgcttgttggatggggaggtaacaatggctccacgctaaccgccggtgttatcgctaatcgggagggaatatcttgggcaaccaaagagaaagtgcaacaagccaactactttggctccttgactcaagcatcaactatcagagttgggtccttcaatggagaggagatctatgcccctttcaagagcctcctccctatggtgaacccagatgacatagtgtttgggggatgggacataagcagcatgaacttggctgatgccatggctagagccaaggttttggacattgatctccaaaagcaattaaggccttacatggaatccatggtcccactccctggtatctatgaccctgacttcattgctgcaaaccaaggtgaacgtgcggacaacgtgatcaagggaaccaaaaatgaacaaatccaaaagatcattaaggacatcagggagtttaaggaggctaacaaggtagacaaagtggtggtcctgtggactgccaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccaacatccatcgtgagctacaatcacttgggaaacaatgacgggatgaacctctcagccccacaaacattcagatccaaggagatctccaagagcaatgttgttgatgacatggtttccagcaacgccatcttatacgagcccggggaacatcctgaccatgtggtcgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcattccatccggtggcaacgattctgagttacctcacaaaggcccctcttgtaccaccagggacaccagtggtgaatgcgctcgcaaagcagagggcgatgctggagaacatactgagggcttgtgttggattggcaccagaaaacaacatgatcttggaatacaagtgaagtgagcatgtgatgacgtgcatgccgtatgatatatgattgttttttatttggttttcgttttcaaatgtaattcgtgtgcttagctttatggaagtatttatttggaggtgaatatatcccaaaataagccaaattttgtggtgaatatgcatccattagtcgcttacacgcgtcaaatagttgtatggaatttaatccctcctaatgtttaagttgttggtaataccaaaattatatatgttctcgttcagtaacctgtatatacataaagtgctgcataagat

SEQ ID NO: 443 - DNA, 1780 bp, Kiwi
ggaaagagcccattaggtctttccccttcccaaatctctctctctctctctctctctctgtttgttgagattcttctttgtgaggaagatgtttatcgagagctttaaggtagagagcccaaatgtgaaatacaccgagggtgagatccactctgtttacaactatgagaccacagagcttgttcatgagaacagaaatgggaactatcaatggattgtcaagcccaagaccgtccaatacgagttcaagaccgacacccatgtcccaaaactaggggttctgcttgttggttggggtggaaacaatggatgtaccctcacgggtggagttattgccaatcgagaaggaatctcgtgggcaaccaaagataaggtacaacaagccaattactttggctcactgacccaagcatccaccatccgagtgggatctttcaatggagaggaaatctatgcccctttcaagagcatacttcctatggtgaacccagatgagatagtgtttgggggttgggacataagtgacatgaacctggcagatgccatggccagggctagggtgttcgatattgacctacagaagcagctgaggccttacatggaatcaatggtcccactgcctggaatctacgacccagatttcatcgccgccaatcagggctcacgtgccaacaacgtcatcaaaggaaccaagaaagagcaactggatcaaattatcaaagatattagggaattcaaggagaagaacaaggtagatagggtggtggtgctttggactgcaaatacagagagatatagcaatgtgattgtgggcttaaatgacacaatggaaaacctctttgcttctttggagaagaatgaggctgagatctctccttccaccttgtatgccattgcttgtgtgcttgaaaacattcccttcatcaatggcagcccacagaacacttttgtcccagggctgattgatttggccataaggaggaacagtttgattggtggagatgacttcaagagtggtcagaccaaaatgaagtctgtccttgttgattttctggttggtgctgggatcaagccgacatcgattgtgagctacaaccatttgggaaacaacgacgggatgaatctctcggcccctcaaactttccggtcaaaagaaatctcgaaaagcaatgtagtggacgatatggtctcgagcaatgccatcctctacgagcccggtgagcatcctgaccatgtcgtcgtcatcaagtatgtgccgtatgtgggagatagcaagagggcaatggatgagtacacgtcggagattttcatgggtggtaagaacacgattgttttgcacaacacgtgcgaggactcgttgttggcggccccaatcatcttggacttggtccttcttgccgagcttagcacccgcattcagctcaaagctgatggagagggcaaatttcactcattccaccctgtggctaccatcctcagctacctcaccaaggcccctcttgtacccccgggcacgccggtggtgaacgcgctgtcgaagcagcgggcaatgctggagaacatactaagggcttgcattgggttgtcacctgagaacaacatgattttggagtacaagtgaagaagaaggaagagcattgtaggaggagatttggttcattacttgtgtgaaaccaattctctcgttttatgaaatataaatgtatctcttaatgttgtaaaaaaagaaaaaaatagtatttacgggattagagtttgtctaaactgggtgatcgttcgc

SEQ ID NO: 444 - DNA, 1779 bp, Platanus
ggaaggaaagggaaagagatttcttctttttgtagttcttatattgcttgggcttctttagtttttgatttcaaaagattatcaagatgttcattgagagtttcaaggttgagagcccaaacgttaagtatacggatcatgagattcaatctatttatagttatgagactaccgagcttgttcatgagaacaggaatggtacctatcaatgggttgtcaagcctaagactgttcaatatgagtttaagactgatacttgtgtacctaaactaggggttatgcttgtgggttggggaggaaacaatggttcaacccttactggtggtgttattgcaaacagagaagggatttcttgggctaccaaagacaaagtacaacaagccaattattttggctcactaactcaggcttcaaccatccgagttggatcgtttgatggggaagagatttatgctcctttcaagagcttactccccatggtgaaccctgatgacattgtttttgggggttgggacataagcgacatgaacttagcagattccatggccagggctaaggtcttggacatcgatttgcaaaggcaattgaggccttacatggaatccatggtcccacttcctggaatctacaaccctgatttcatagcagccaaccaagggtctcgggctaataacgtgatcaaggggaccaaaaaagaacaagttgaacaaatcatgaaggacataagggagttcaaggaagctaataaggtagacaaggtggtggttctgtggacagccaacacagagagatacagtaatgtagttgttgggctaaatgacaccatggagaacctctcagcttcgttggacaagaacgaagacgagatatctccatcgaccatgtacgctttggcttgcatcctcgaaaacgtccctttcatcaatggaagtccacaaaacacctttgttccagggctgattgatttagccataaagagaaacagtttgatcggtggggatgatttcaagagtggccaaaccaagatgaaatctgtcttggttgattttcttgtgggggctggaatcaagccaacatctatagtgagctacaaccacttgggcaacaacgatggcatgaatctctctgctcctcaaactttccggtccaaggagatatcaaagagcaatgttgtggacgatatggtgtctagcaacggtattctctacgagcccggcgagcacccagaccatgtcatcgtcatcaagtacgtgccatacgtaggagacagcaagagagcaatggacgagtatacgtcggagatattcatgggtgggaagagcaccatcgttcttcacaacacctgtgaggactccttgcttgctgctccaattatccttgacttggtcctcttggccgagctcagtacccgaatccaactcaaagctgaaggggagggaaagttccactctttccaccctgtagctaccatcctcagttacctcaccaaggccccacttgttccaccagggacccctgtggttaatgcactgtcaaagcagagggcaatgcttgagaacatattgagggcttgtgttggattggctccggagaataacatgattttggaatacaagtgaaagttgatatgattgagttcaagaaatgtaagagacgtttgtataataatgtgtgagaaatatgggctcttgttagttctcctttatttcacatgtacttggtagatttggggcatttagtgcaagtactcctcaagtcatatgtaaatttatgtaaaaa

SEQ ID NO: 445 - DNA, 1878 bp, Platanus
ggaaagaaaaagagtagcttttcttcttctttcttgcttgagttgttgttgcttgggtttgtttttcatctcagattgggaagatgttcattgagagtttcaaggttgagagccctaacgttaagtacacagatcatgagattcaatctgtttatagctatgagaccactgagcttgttcatgagaacaagaatggtacctatcaatggcttgtaaagcctaagaccgttcagtatgagttcaaaactgatactcgtgttcctaaactaggggttatgcttgtgggttggggaggaaacaatggttcaaccctcactggtggtgttattgcaaatagagaaggaatatcttgggctaccaaagacaaagtacaacaagccaactattttggctcactaacccaggcttcaaccatccgagttggatcttttaatggggaagagatttatgctcctttcaagagtttactacccatggtgaaccctgatgatattgtttttgggggttgggacatcagtgacatgaacttggctgatgccatggccagggctaaggtcttggacatcgatttacaaaggcagttgaggccctacatggaatccatggtcccacttcctggaatctacgactctgatttcattgcagccaaccagggatctcgtgctaacaacgtgatcaaggggactaagaaagaacaagttcaacaaatcatgaaggatattagggagttcaaggaggctaacaaggtagacaaagtagtggttctgtggacagccaacacagagagatacagtaatgtagttgttgggctgaacgataccatggaaaacctcttagcttcattggagaagaacgaagtggagatatctccatccaccttgtacgctttggcttgtgtctttgagaacgttcctttcattaatggaagtccacaaaacacttttgttccaggcctgattgatttggctataaagaggaacagtttgattggtggagatgatttcaagagtggccagaccaagatgaaatctgtcttggttgattttcttgtgggtgctggaatcaagccaacctctatagtgagttataatcacctggggaacaacgatgggatgaatctctctgctcctcaaacattccggtcgaaagagatctcaaagagcaatgttgtggacgatatggtttcaagcaacggtattctctacgagcccggcgagcaccctgaccatgtcatcgttatcaagtatgtgccatacgtgggagacagcaagagagcaatggacgagtacacatcggagatattcatgggagggaggagcaccatcgtcctgcacaacacctgcgaggactccttgttggctgctccaattatcttagacttggtcctcttggccgagctcagtacccgaatccaactcaaagctgagggagagggcaagttccactctttccacccggtggctaccattctcagttacctcaccaaggccccacttgttccacctggcactcctgtggttaatgcactgtcgaagcagagggcaatgcttgagaacataatgagggcctgtattggtttggctccggagaataacatgattttggaatacaagtgatagtgaagatgatctgattcaagatcccttttttttatttctttttttgtagcaagaagtgtaagaaagtttatacatgagaaatatgggcttttgttagtctttgtgtggtgttgctatggtgttcgtacaaggcctgtctgcggacttgtgctaggtgttttgtatcgtcgccaaatgtatgtcatgcaaataagtgcaagtactttactgtaatagtgatgaaaatcacatattaatatatgtcagaaatgtttataat

SEQ ID NO: 446 - DNA, 1585 bp, Vinca
ttaaggatgtttatcgagagctttaaggttgacagtgccaatgttaagtacacagaatctgaaatccattccgtgtataactatgaaacaactgaacttgttcatgagaacagagatggtacttatcaatggattgtcaagcccaaaactgttaaatatgagttcaagactgatacccttgtccctaaacttgggattatgcttgttgggtggggagggaacaatggttcaactctcactgctggtgtcattgcaaacagagagggaatttcatgggcaactaaagataaagtgcaaagagcaaattactttggttccctgactcaggcatcaactattcgagttgggtcctttaatggggaagagatctatgcccctttcaagagcttgctccccatggtcaaccctgatgatattgtgtttggagggtgggacatcagtaacttgaacttggcagatgccatggctaggggcaaggttttagatattgatcttcagaagcaattgaggccctacatggaatccatggtccctcttcctggtatatatgaacctgatttcattgctgctaaccaagggtctcgtgccaacaatgtcctcaaaggaaccaagaaagaacaaatgcaacaaatcatcaaagatattaaggagtttaaggagaagaacaaggttgataaagtagtggttctttggacagcaaacacagaaagatatagtaatgtggttgttgggcttaatgatactgtggaaaacctttttgctgctttggatagaaatgaagctgagatctctccatccactttgtatgctatagcttgtgttcttgaaaatgtgcctttcattaatggcagcccacagaacactttcgtcccaggattgattgatttggctattaagaggaacagtttaattggtggagatgacttcaagagtggtcagactaagatgaaatcagttcttgttgatttccttgttggggctggtatcaagccaattctatagtgagctacaaccatttaggaaacaacgatggaatgaatctttccgcccctcaaactttccaatccaaggagatttccaagagtaatgttgtggatgatatggtagccagcaacgctatcctctatgaaccgggcgagcatccggaccacgttgtcgtgatcaagtatgtaccgtatgttggagatagcaagagggctatggatgagtacacatcagagatattcatgggtgggagaaacaccatagttctgcacaacacttgtgaagactcacttttggctgctccaattatcttggacttagtcctcctcgctgaactcagcactcgcattcaactcaaatctgaagctgagggcaagttccactcattccatcctgtggctgccatcctcagttacctctccaaggcccctcttgtaccaccaggcacaccagtggtgaatgctctgtcaaagcagagggcaatgctggagaatataatgagggcttgcgttggacttgcaccagagaacaacatgattttggagtacaagtgaagaatgtgaagaagatcaacagaaattaatcgaaatgtgtagtttga

SEQ ID NO: 447 - DNA, 1843 bp, Amsonia
cttcttgaggccgagaggttttttttccccatttttcaatctctctccgcttcttttcagtgtttgacattcttaatttgttgggtttttgcaaatctaaagatgttcattgagagctttaaggttgacagtgccaatgtcaaatacactgagagtgaaattcactctgtgtacgactatcaaaccactgaacttgttcatgagaacagggatggtacttatcaatggattgtcaagccaaagtccgtcaaatacgaattcaagactgatactcgtgtccccaaactaggggttatgcttgttgggtggggagggaacaatggttcaactctcaccggtggtgtcattgcaaaccgagaaggaatttcatgggcaaccaaagacaaggtgcaacaagccaattactttggttcccttactcaggcatcaactgttcgagttggttctttcaatggggaagagatctatgctcctttcaagagcttgctcccaatggtcaaccctgaagatattgtgtttggagggtgggacatcagcaacatgagcttggcagatgccatggctagggctaaggtcctagatattgatcttcagaagcaattgaggccctacatggaatccatggtccctcttcctggtatctatgaccctgatttcattgctgccaaccaagggtcccgagccaacaacgtcatcaaaggaaccaagaaagaacaaatgctacaaatcatcaaggatattcgggagtttaaggagaagaacaaggtggacaaggtagtggttctgtggactgcaaacacagagagatacagtaatgtagttgttgggcttaatgacaccgtggaaaacctttttgctgctttggatagaaatgaggccgagatttctccatctactttgtatgccatagcttgtgtgcttgaaaatgtgcctttcattaacggcagcccacagaacacttttgtcccaggcttgattgatttggctattaggaggaacagtttaatcggtggagatgacttcaagagtggtcagaccaagattaaatctgtgcttgtggatttccttgttggagctggtatcaagccgacttcaatagcgagctacaaccatttgggaaacaatgatgggatgaatctttctgcccctcaaacttttcgctccaaggagatttccaaaagtaatgtggtggatgatatggtagccagcaatgctatactctacgaacccggcgagcatcctgaccatgtggttgttatcaagtatgtgccatatgttggagatagcaagagggctatggatgagtacacatcagagatattcatgggtggaaagaacaccatagtgctgcacaacacttgtgaagactcccttctggcggctccaatcatcttggacttggtcctccttgctgaacttagtactcgcattcagctcaaatctgaagctgagggcaagttccactcattccaccctgtggctaccatcctcagctacctcaccaaggctcctcttgtaccaccaggcacaccagtggtgaatgcactttccaagcagagggcaatgctggagaatatcatgagggcttgtgttggacttgcaccagagaacaatatgattttggagtacaagtgaagaagacgatgaagaatagcaagagaaaatcaatcgaaaatgtagtttagtacttaatcaaagggaccattcatttttctttctgttttttttcccactttattatttcttttggtatcatgtgtccatgtctttatgaagatgtaatattattaatggtggtccataactattgtaatgtcggatattgtcctcttttgtgtatcct

SEQ ID NO: 448 - DNA, 1875 bp, Beech
attctgtttaggattgacagaagaggaagagagatacatattcaagtcttcttcttcatcttctccttcagcttcttgttgttgtttattaagttctgtttggtccattattgtttagtttctcttgtagaaaaaaaaaaaaaaaatgttcattgagagctttaaggtagacagtcctaacgttaagtacacagagaatgagattcactctgtttacaattatgacaccactgagcttgtacatgagaacaggaatggcacctatcagtggattatcaagcccaagactgtaaaatacgaattcaagactgagacccatgtccctaaactgggggttatgcttgtgggatggggaggaaacaacggttcaaccctcactgctggtgttattgccaaccgagaaggaatctcctgggccaccaaggacaaagtgcaacaagccaattattttggctcactgacccaagcatcaacaattcgtgttgggtctttccatggagaggagatctatgctcctttcaagagcttgctcccgatggtgcacccagatgacattgtgtttgggggttgggatattagtgacatgaacctagcagatgctatggccagggccaaggtcctggacattgatttgcagaagcaattgaggccctacatggagtccatggtcccactccctggaatcttcgaccctgattttattgctgctaaccaaggtgcacgtgccaacaacgtgatcaaagggaccaagaaagaacaagtccaacaaatcattaaagatattagggagttcaaggaggcaactaaggtggataaggtggtagtgctgtggactgccaacacagagaggtatagcaatgtgattgtggggctaaatgacacagaggaaagcctcttagcttctgtggacaagaatgaggctgagatatctccttccaccttgtatgcattggcttgtattcttgaaaatgttgctttcatcaatggaagccctcagaacacttttgttccaggactgattgagttggctattaagaggaacagtttgattggtggggatgacttcaaaagtggtcagaccaagatgaaatctgtgttggtcgatttccttgttggggctggtattaagccaacatccatagtgagctataaccacttgggaaacaatgacggcatgaatctctctgccccacaaaccttccgctccaaggaaatctccaaaagtaacgttgttgatgacatggtttctagcaacgctatcctctatgaacccggagagcatcctgaccacgtcgtggtcattaagtatgtgccatacgtgggggatagcaagagagccatggatgagtacacctcagaaatattcatgggtgggacaaatactatagtgttgcacaacacatgcgaggactccctgttggcagcacccatcatcctagatttggtgcttcttgctgagctcagctcccgtatccagctgaaagctgaaggagagggcaaatttcactcattccaccctgtggctactattcttagttaccttaccaaggcccctcttgttccaccaggcacgcctgtggtgaatgcactgtcgaagcagcgggctatgcttgagaacattatgagggcttgcgttggattggctcctgagaacaacatgattttggaatataagtgaatttagaggaagggattgatgggagattggttattaatgtttaggaattgttccccaaagtctatgtttcatgttaatgttggtgtgagaggattgttagtagcattctatgttgaaagtttctgatttatatgttttgtaaaggcgcttatttgtggccctgttggctgttgcttcagttcattcctggaccaagc

SEQ ID NO: 449 - DNA, 1838 bp, Cotton
aaagcagtgtttcaagaacagaatatcggcaaaaatgttcattgagagctttaaggttgagagtccaaatgtcaagtacacagacaatgcaatccagtcggtgtacaactatgagactactgagcttgttcatgagaacagggatggaacctatcaatgggttgtcaagcccaagactgttaaatatgaattcagaactgatatccatgtccctaaactgggggtaatgcttgttggatggggaggaaacaatggctcaaccctgactggtggtgttatagctaaccgatggggagtgtcctgggccactaaggacaaggtgcaacaagctaattactttggttcacttactcaagcatcaactatccgagttgggtcttacaatggggaggagatttatgctccctttaagagccttcttcctatggtgaacccagaggatattgtatttggaggatgggacataagtgacatgaaccttgctgatgcaatggctagagccaaggtctttgacattgatctgcaaaaacagctaaggccctacatggaatccatggtcccactccctggaatctacgacccagatttcattgctgccaaccaaggtgaacgtgccaataacgtcatcaagggtaccaagaaagaacaagttcagcaaatcattaaagatattagggagttcaaggagaaaaacaaggtggacaaggtggttgtactctggactgcaaacactgagaggtacagcaatgtcgttgtggggctaaacgacaccatggagaacctcttggcttcttttgagaagaatgagtcagagatttctccttccactttatacgctatcgcttgtgtttttgaggatgttcccttcatcaatggaagcccacaaaacacatttgttccagggttaattgatttggctatccagaggaactgtctgattggaggagacgattttaagagtggccagaccaaaatgaaatccgttctagtggatttccttgttggggctggtatcaagccaacatcaatagtgagctacaaccatctgggaaataatgacggcatgaatctatcagctccccaaactttccgctccaaggagatctccaagagcaatgttgtggatgacatggtctcaagcaatggaatcctttatcaacccggtgaacatcctgatcatgtcgtggtcatcaagtatgtgccatatgtgggagatagcaagagagccatggatgagtacacatcagagatattcatgggaggcaagaacaccattgtgttgcataacacatgcgaggactccctgttggctgctcccatcatcctagatttggttctccttgctgagcttagcaccaggatccagctcaaggctgaaggagagggcaagttccactctttccaccctgtggctactatcctcagttacctcaccaaggcccctctcgttccaccaggcacacccgtggtgaatgcactgtcaaagcaacgtgcaatgctggagaacatactgagggcctgtattggcttgtcccctgaaaacaacatgattctggagtacaagtgaaaatcgaggagagaaaaagtggaacaagcattgctccttgcaactttaggaccattttccctttctctttcataaaagatgtggtccatgttgccacactttgtaatggttttatggttgatatattttcatctttgtttctctctctgtttctggatggcgctcatgtaacgcctcctgtcgctcaagcttgagcaagcaatctcttttgtggaaatagatatgataatgataatatgaaagtttaattaatatgttcaaaaaaaaaaaa

SEQ ID NO: 450 - DNA, 1899 bp, Gossypium raimondii
cggtccctaacaatggagcaccaaagctttaaaacaaacccaaaaaacaaagcagtgtttcaagaacagaatatcggcaaaaatgttcattgagagctttaaggttgagagtccaaatgtcaagtacacagacaatgcaatccagtcggtgtacaactatgagactactgagcttgttcatgagaacagggatggaacctatcaatgggttgtcaagcccaagactgttaaatatgaattcagaactgatatccatgtccctaaactgggggtaatgcttgttggatggggaggaaacaatggctcaaccctgactggtggtgttatagctaaccgatggggagtgtcctgggccactaaggacaaggtgcaacaagctaattactttggttcacttactcaagcatcaactatccgagttgggtcttacaatggggaggagatttatgctccctttaagagccttcttcctatggtgaacccagaggatattgtatttggaggatgggacataagtgacatgaaccttgctgatgcaatggctagagccaaggtctttgacattgatcttcaaaaacagctaaggccctacatggaatccatggtcccactccctggaatctacgacccagatttcattgctgccaaccaaggtgaacgtgccaataacgtcatcaagggtaccaagaaagaacaagttcagcaaatcattaaagatattagggagttcaaggagaaaaacaaggtggacaaggtggttgtactttggactgcaaacactgagaggtacagcaatgtcgttgtggggctaaacgacaccatggagaacctcttggcttcttttgagaagaatgagtcagagatttctccttccactttatacgctatcgcttgtgtttttgaggatgttcccttcatcaatggaagcccacaaaacacatttgttccagggttaattgatttggctatccagaggaactgtctgattggaggagacgattttaagagtggccagaccaaaatgaaatccgttctagtggatttccttgttggggctggtatcaagccaacatcaatagtgagctacaaccatctgggaaataatgacggcatgaatctatcagctccccaaactttccgctccaaggagatctccaagagcaatgttgtggatgacatggtctcaagcaatggaatcctttatcaacccggtgaacatcctgatcatgtcgtggtcatcaagtatgtgccatatgtgggagatagcaagagagccatggatgagtacacatcagagatattcatgggaggcaagaacaccattgtgttgcataacacatgcgaggactccctgttggctgctcccatcatcctagatttggttctccttgctgagcttagcaccaggatccagctcaaggctgaaggagagggcaagttccactctttccaccctgtggctactatcctcagttacctcaccaaggcccctctcgttccaccaggcacacccgtggtgaatgcactgtcaaagcaacgtgcaatgctggagaacatactgagggcctgtattggcttgtcccctgaaaacaacatgattctggagtacaagtgaaaatcgaggagagaaaaagtggaacaagcattgctccttgcaactttaggaccattttccctttctctttcataaaagatgtggtccatgttgccacactttgtaatggttttatggttgatatattttcatctttgtttctctctctgtttctggatggcgctcatgtaacgcctcctgtcgctcaagcttgagcaagcaatctcttttgtggaaatagatatgataatgataatatgaaagtttaattaatatgttcaatccaccatctcttatatttctgt

SEQ ID NO: 451 - DNA, 1860 bp, Kiwi
ggtctttcccccttccgtatttgactctctctctccctgctttctcactctaggattgttgagattcttttctggggaagatgtttatcgagagctttaaggtggagagcccaaatgtgaagtacacagagggtgagatccactctgtttacagctacgagaccacagagcttgttcacgagaacagaaatgggacctatcaatgggttgtgaagcccaagacggtccaatacgagttcaagaccgatacccatgtccccaaactaggggttatgcttgttgggtggggtggaaacaatggatgtaccctcacgggtggtgttattgccaatcgagaaggaatctcgtgggcaaccaaagataaggtacaacaagccaactacttcggctcactcacccaagcatccaccatccgagttggatctttcaatggagaggagatctatgccccgttcaagagcatacttccaatggtgaaccccgatgagatagtgtttggcggttgggacataagtgacatgaacttggcagatgccatggccagggctagggtattcgacattgatctgcagaagcagctgaggccatacatggagtccatggtcccactccctggaatctacgagccagatttcatcgccgccaatcagggctcacgtgccaacaacgtcatcaaaggatccaagaaagaacaagttgatcaaattattaaagacattagggaatttaaggagaagaacaaggtagatagggtggtggtgctttggactgcaaatacagagagatacagcaatgtgattgtgggcttaaatgacacaatggaaaacctctttgctgctttggagaagaatgaggctgagatctcaccttccacgttgtatgccattgcttgtgtgctggaaaacattcccttcatcaatggcagcccacagaacacttttgtcccagggttgattgatttggccataaggaggaactgtttgattggtggagatgacttcaagagtggtcagaccaaaatgaagtctgtccttgttgatttccttgtgggtgctggtatcaagccgacatcgattgtgagctacaaccatttgggaaataacgacgggatgaatctctctgccccccaaactttccggtcaaaagaaatctcgaaaagcaacgtagtggacgacatggtctcgagcaatgccatcctctatgagcccggtgagcatcctgaccatgtcgttgtcatcaagtatgtgccatatgtgggagatagtaagagggcaatggatgagtacacgtcggagattttcatgggcgggaagaacacaattgtgttgcacaacacgtgcgaggactcgttgttggcggccccaatcattttggacttggtccttctcgctgagctcagcactcgcattcagctcaaagctgatggagagggcaaatttcactcattccaccctgtggctaccatcctcagctatctcacaaaggcccctcttgtacccccgggcacgccggtggtgaacgcgctgtcgaagcagcgggcgatgctggagaacatactgagggcttgcattgggttgtctcctgagaacaacatgattttggagtataagtgaagaagaagcataggaggaggagatttggttcattacttgtgtggaaccatttttcttctctctcttttgttttatgagacagaaatgtatctcttaatattgttaaaaaaaaatgtagtatctatgggattagagtttgtctaaaccgggtgatcgatcgatcggttattgctgtttccttgttttctgaattgtggttacaatgtgtactctgtttgctctgcctcagttatagagcaaacaaacc

SEQ ID NO: 452 - DNA, 1683 bp, Phlya
tctttcgagacataaatatatatatttttttttgctaaatcaaaacaaacaacaaaaataaatcgaagatgtttatcgagagctttaaggttgacagcccgaatgttaagtacaccgagggtgaaattcactctgtgtacaactatgaaaccacggagcttgttcatgagaacagaaatggcacctatcagtggattgtcaagcccaagaccgtcgaatatcagttcaaaactgatacccacgtacccaaattaggggttatgcttgtcggatggggaggtaacaatggttcaactcttaccggtggcgtcattgcaaatcgagaggggatttcatgggcaacaaaagacaaagttcaacaggccaattattttggatcgctgacacaggcatcctcaatcagagttggttccttcaatggagaagagatttacgcccctttcaagagtcttcttcctatggtcaatcccgatgacgtagtatttggaggatgggacatcagcaacatgaacttggctgatgcaatgggcagggctaaggtgttagatattgatcttcagaagcagctaaggccctacatggaacacatggtcccactccctggaatctacgatcctgatttcatagctgccaatcaggggccacgtgccaataacgtgatcaaaggaaccaagaaagaacaagttcaacaagtcattaaggacatcagggagtttaaggagaagaataaggtggataaggttgtagtattgtggacagccaacacagaaagatacagtaatgttatcgttgggctaaatgatacttctgagagtttaatggccgcagttgagagaaatgaggcagagatatctccttcaaccttatatgccattgcttgtgttcttgaaaacgttcccttcatcaatggcagtccacaaaatacttttgttcctgggatgattgatttggccatccagcataacactctgattggtggagatgatttcaagagtgggcaaacaaagatgaaatcagttctggttgatttccttgttggagctggtattaagccgacgtcgattgtgagctataatcatctgggaaacaatgacgggatgaatctatcagccccacaaacattccggtctaaggagatctccaaaagcaatgtggttgatgacatggttgccagcaatggtatcctttatgaacctggagagcaccctgaccacgttgttgtcatcaagtacgtgccttatgtgggtgacagcaagagggcaatggatgaatacacttctgagatattcatgggagggaagagtaccattgtgctgcacaacacgtgtgaggactctcttcttgcagctccaatcatcttggatttagtcctacttgctgagctcagcactcgcattcagctcaaagcccaaggagagggcaagtttcattcgtttcatccggtggccactatcctaagctacctaacaaaagcacctcttgtaccaccaggcacaccagttgtgaatgcactatcgaagcagagggctatgcttgagaacatcttgagggcttgtgttggattggctccagaaaacaacatgattctggaatacaagtaaaaactctgtgggaagagtatttatcccaccaaataagcaacaatcccataatcgatttttcttatgtttttagctttttttt

SEQ ID NO: 453 - DNA, 1960 bp, Tomato
ataaagcaaaatagaatcttgaacacttgttcttcttctaaattgaatagcttgttctgattttttttggtcaaaatgtttattgaaaattttaaggtggaaagcccaaatgtgaagtatattgagaatgaaattcattctgtgtatgattatgaaaccacagagcttgttcatgaagagagaaatggaacttatcaatggattgttaagcctaaaactgtcaaatatgaatttaaaactgatacccatgtgccaaaattgggggttatgcttgttggatggggaggaaacaatggttcaacattgactggaggtgttattgcgaatcgagaaggaatttcatgggcaacgaaagaaaaagtgcaacaagccaattattttgggtctcttactcaggcatcaaccattcgagttgggtctttcaatggcgaagagatctatgcacccttcaaaagcctccttcccatggtcaacccagacgatgtagtatttggaggatgggacattagcaacatgaatttggcagatgctatggtcagggctaaggttttcgaagttgatctgcaaaagcagctgaggccctacatggaatccatggttccccttcctggtatctatgaccctgacttcattgcggctaaccaagaagcacgtgccaacaacgtgatcaaaggaaccaagaaagaacaagttgaacaaattgttaaagatattagggagttcaaggagaagaacaaggtagacaagatagtggttctatggactgccaacaccgaaaggtacagtaatgtggttgttggccttaatgacaccatggaaaaccttttagctgctgtggatagaaatgaggctgaaatatctccttctacattgcatgctattgcttgtattatggaaaatgtgcctttcatcaacggaagccctcaaaacacttttgttccaggtcttattgatttggccataaagagaaacactttaattggtggtgatgactttaagagtggtcaaaccaagatgaagtccgtgttggttgatttccttgttggagccggtattaagccaacgtcaatagtgagctacaatcacttgggtaacaatgatggaatgaatctttctgctcctcaaaccttccggtctaaggagatctcaaaaagtaatgttgttgatgacatggttgctagcaacgccattctctatgaatctggcgagcaccctgaccatgttgtcgtgatcaagtatgttccatatgttggagacagcaagagggcaatggatgagtacatgtcagagattttcatgggcggaaagagcactatagttatgcacaacacttgtgaggactctcttttggcagctccaattatcttggatttggtccttctcgctgaactcagcactcgcattcagctcaaagctgaaggggaggggaagttccactccttccaccctgtggctactattctcagctacctcaccaaggctcccctggtaccaccaggtactccagtggtgaatgccctttcaaagcagagggcaatgcttgagaatataatgagagcttgtgttggtttggcaccagagaacaacatgattttggaatacaaatgaaaaatatatatgcagatgaagaaaaattactagaagagaatggacttaactcaagtgtagttgcatttgtagaaaagatcattctctatttaattttttttgtccctattatatcttatattttgtttccattttctcatcatataattaagttaagtgtggcatgattgtgaagtgtaggagagcttaaaagggccaaagtcttattcattgcaacttcttctcttcatgtttttggccctcttatctccaaattgtatgttggttgctttagctcagatagagccagcaatatcttgtttctattggaaaaaaaaatataacatggtgatttaaattttgttttagaaat

SEQ ID NO: 454 - DNA, 1671 bp, Catharanthus
ttgagaactttaaggtcgacagtgctaatgttaagtatacagacactgaaattcattctgtttacgattatgaaaccactgaacttgttcatgagaacagagatggcacttatcaatggattgtcaagcccaagactgttaaatacgagttcaagactgatacccgtgttcccaaattaggggttatgcttgttggttggggtgggaacaatggttcaactctcaccggtggtgtaatcgctaaccgagaaggaatttcatgggcaaccaaagaaaaggtgcaaagagccaattactttggttcccttactcaggcttcaactattcgagtcgggtcctttaatggtgaagagatctatgccccttttaagagcttgcttcccatggtgaaccctgatgatgtgtttttggagggtgggacatcagcaacatgaatttggccgatgccatggctagggccaaggtgtttgaaattgatcttcagaaccaattgaggccctacatggaatctatggtccctcttcctggtatctatgaccctgatttcattgctgccaaccaagggtcccgtgccaacaacgtcatcaaaggaaccaagaaagagcaaatgcaacaaatcatcaaagatattcaggagtttaaggagaagaacaaggtagataaggtagtggttctgtggactgcaaacacagagagatatagtaatttggttgttgggcttaatgacaccatggagaacctttttgctgctttggatagaaacgaggctgagatttctccatctactttatatgcccttgcttgtgttcttgaaaatgtccctttcattaatggcagcccccagaacacttttgtcccagccttgattgatttagctattaagaggaacagtttgattggtggggatgacttcaagagtggtcaaaccaaaatgaaatcagtacttgttgatttccttgttggagctggtatcaagccaacttcaatagtgagctacaaccatttgggaaacaatgatggtatgaatctttcagcccctcaaacattcaggtccaaggagatttcgaaaagtaatgtggtggatgacatggtagccagcaatgctatcctttacgaaccaggagagcatcctgaccatgttgttgtgattaagtatgtgccatacgttggagatagcaagagggctatggatgagtacacatcagagatattcatgggtggcaaaaacaccattgttctacacaacacttgtgaagactcacttctggcggctcccatcatcttggacttggtcctccttgctgaactcagcactcgcattcagctcaaatctgaggctgagggcaagttccactcattccacccagtagctaccatcctcagctacctcaccaaggcccctctggtaccaccagggacaccagtggtgaatgctctatcaaagcagagggcaatgctggagaatataatgagggcttgtgttggacttgcaccagagaacaatatgattttggagtacaagtgagaaacaagaaagatgaagaatttgatgagaagagtaattaatcaatctgataaaaaatgtagtttagtacctagtagttcaaagggatcatttttgccctttctttttcctttttttttttgtggtactataaatatgtgtctaat

SEQ ID NO: 455 - DNA, 2396 bp, Cacao
actcccgtgttttttccacgccttacatagagcgtggaaatgggtccgacgactatccgctcattcaatcaagcaatcaaaccgctccctcaaatttcacgagtcgtagtcacccgtttccttcgagtatcttcttaagggcatcgaccccacacacatggaaaactccccaaaactttcccctcagtggatcagtccacgtgtaaagcgcatctcacttgtcccaatgattcctcctcctcacacatgtcttcccatacgtgtggttcaatggtccgtttaaaaaaaaagaagaagaaggaaaacaattcgatcggaaaacagaggaagaagaacaaaatgaaacgattcatggccaaggttctctcaaagccaaacaccaattataaaatttaatgtgggccatccaccattgacacaacgccacgtgtatcatcgtagcatacatctcctctataaatacactcatattgccaagcaatggagcacaaaattttgcgaaagctaagaaaagaaaaaaggaggcagtttctctagtttgggtttcattgttgttctcggttgtgttttttagccttaagaaaagcatcggcaaaaatgtttattgagagctttaaggtagagagcccaaatgtgaagtacacagacaatgagattctgtcggtgtacaactatgagaccaccgagcttgttcatgagaacaggaatggaacctatcaatgggttgtaaaacctaagaccgtcaaatatgaattcaagactgatacccatgtccctaaactaggggtgatgcttgtgggatggggaggaaacaatggttcgactctgactggtgctgttatagccaaccgagagggaatctcctgggccactaaggacaaggtgcaacaagccaattactttggttctcttactcaagcatcaacaatcagagttggatcttacaatggagaggagatttatgccccatttaagagccttctccccatggtgaacccagaggatattgtgtttggagggtgggacataagtgacatgaacctagctgatgcaatggctagggccaaggtttttgatattgatttgcagaagcagctgaggccctacatggaatccacggtcccaatccctggaatctacgacccggatttcattgctgccaaccaaggtgaacgtgccaacaacatcatcaaggggaccaagaaagaacaagttcagcaaatcatcaaagatattagggagttcaaggagaaaaacaaggtggacagggtggttgtactctggactgcgaacactgagaggtacagcaatgtaattgtaggtctaaacgacaccatggagagcctcttgggttctctggagaagaatgaatcagaaatatctccttccactttgtacgccatcgctagtgttcttgaaaatgttcccttcatcaatggaagcccacaaaacacctttgttccagggttaattgatttggctattcagaggaactgcctgattggaggagatgactttaagagtggccagaccaagatgaaatctgttctggtggatttccttgttggggctggcatcaagccaacatcaatagtgagctacaaccatcttggaaacaatgatggcatgaatctatcagctccccaaaccttccgctccaaggaaatctccaagagcaacgttgttgatgacatggtctcgagcaatggtatcctctatgagcctggtgaacatcctgaccatgttgtggtcatcaagtatgtgccatatgtgggagatagcaagagagccatggatgagtacacatcagagatattcatgggaggccagaacaccattgtgttgcacaacacatgcgaggactccctgttggctgctcccatcatcctggatttggttcttcttgctgagctcagcaccaggatccagctcaaagctgaaggagagggcaagttccactctttccaccctgtggctactatcctcagttacctcaccaaggcccctcttgttccaccagggacaccagtggtgaatgcactgtcaaagcagcgtgcaatgctggagaatatactgagggcctgcattggcttggctcctgaaaacaacatgatcttggaatacaagtgaagttgaggagagaaaagtggaagaacaagctttggttcttagaactttaggaccattttccctttctctttcataaaagctgtggttcacgttgtcacagattctgatggttgtgtgatgatttgtggtcggtatattatgtttttctctcttttcggatggcgctcacgtgtagctcccttgatgtagctcaatcctgagcaagcacctcttttgtggaaatagatatgataatatgaaagtttataaatgtgtttaatgcacca

SEQ ID NO: 456 - DNA, 1807 bp, Clover
gctttcttactttttctcttcaatattttcttaatttcttcaagtaaccaaaatgttcatcgagaattttaaggttgagagtcctaacgtgaagtacacagagactgagattgagtccgtgtacagttacgaaacaaccgaacttgttcatcagaagaacacaaatgacacttatgagtgggttgttaagcccaaaactgtcaaatatgaatttaaaactcaaaccaatctccctaaattaggggtaatgcttgttgggtggggtggaaacaatggttcatccctcactggtggtgttattgcaaaccgagagggtatttcatgggcaacaaaggacaatattcagcaagccaattattttggttcactgacccaagcatcagctatcagagtggggtctttccaaggggaagaaatctatgccccattcaagagccttcttccaatggtaaaccctgaggacatagtgtggggaggatgggatatcagtgacatgaacctagctgatgccatgggtagagccaaggtgtttgacatagacctacagaaacagttgaggccttacatggaatccatggttccactccctggaatctatgaccctgatttcattgctgctaatcaaggagatcgtgctaacaacatcattaaaggaacaaagaaagaacagcttcaacaagtcatcaaagacattaaggagtttaaggaagctaacaaggttgacaaggttgttgtactttggactgcaaacactgagaggtacagtaatattgttgtgggactaaatgacactatggagaatctcttggcttctgtggacaagaatgaatctgagatttctccttcaaccctatttgctttggcttgtgttcttgaaaatgttcctttcatcaatggaagccctcaaaacacctttgtcccagggttgattgatttggctatcaaaaggaacagtttgatcggcggagatgacttcaagagtggtcagacaaaaatgaagtctgtgctagttgatttccttgtgggagctggtatcaaaccaacatcaatagtgagttacaaccatttgggaaacaatgatggaatgaatctctctgcaccgcaaaccttccgctccaaggaaatctcgaagagcaacgtcgttgatgatatggttaacagcaatgcaatcctctatggacctggtgaacatccagaccatgttgttgtcattaagtatgtgccttatgtgggagacagcaagagagcaatggatgagtacacttctgagatatttatgggtggaaagaacactattgtgatgcataacacatgtgaagattctcttttggctgctccaattatcttggacttggtccttcttgctgagcttagcactagaatccagttcaaatctgaacatgaggacaagttccacacattccaccctgttgcaaccatcctcagttacctcactaaggctcctcttgttccaccaggtacaccagtagtgaatgcattatcaaagcagagatctatgctggaaaacattctgagagcttgtgttggattggcacctgagaacaacatgatccttgaatacaagtgaagtgtaccatttgaattagaagaaacttgggataactcaatatagtagtgtgtccaaagcttatcccatggtcctctatttgctgttgtgatattttgatatgtttggttagcataatgtacctaccaacatttcaccgtgttttcctgccggcttaatttagagcactgagcaggcggccatcttaatatatcgaataatattcacttgtcaaaaaaa

SEQ ID NO: 457 - DNA, 1861 bp, Euonymus
gaagctaagcttagtcttcttgttttgctcaatttcttgcgaaatttaagcggcttttgctcttgtttctctacccctcttatttttatttactgagcaaaaatgtttattgagaattttaaggttgagagtcctaacgtgaagtacacagagactgagattcattctgtgtacaactatgagaccacggagcttgttcatgagaacaagaatggctcatatcaatggactgtcaaacccaaaactgtcaaatacgaattcaagaccgacaccagtgtccctaaactaggggttatgcttgtgggatggggaggaaacaacggttcaaccctcaccggtggtgttatagcgaaccgagaaggaatctcttgggcaaccaaggacaaggtgcagcaagccaactactttggctcactaacccaggcatcatcaattcgagttgggtcttacaatggagaagaggtctatgctccatttaagagccttcttcctatggtgaacccagatgagatagtgtttgggggttgggacataagtgacatgaatttggctgatgccatggccagggctaaggtttttgatattgatttgcaaaagcagctaatgccctacatggaacatatggtcccactccctggaatctatgatcccgatttcattgctgccaatcaagactcacgtgccaacaacattatcaaaggcactaagaaagaacaagttcaacaagttatcaaagacattagggaattcaaggaaaaaaccaaagtggacaaggtggttgtgctgtggactgccaacacagaaagatacagtaatgtaattgtgggcttaaacgacactattgagaatctgtttgcttctttggacaaagatgaagcagagatttctccttccaccttgtatgctttggcttgtattcttgagaacattcctttcatcaatggaagcccacagaacacttttgttccaggactaattgatttggccataaagaggaacagtttgattggtggagatgactttaaaagtggtcagaccaaaatgaaatctgtgctggttgatttccttgttggggctggcatcaagccaacatcaattgtcagctacaaccatttgggaaacaatgatggcatgaatctctcagcaccccaaaccttccgatccaaagaaatctccaaaagtaatgtcgtggatgacatggttgcaagcaatggtatcctcttcgagccgggcgagcatcctgaccatgttgtggtcattaagtatgtgccatatgttggagacagcaagcgagctatggatgagtacacatctgagatattcatgggtgggagaaacacaatagtgctgcacaacacatgcgaggattcactcctggctgcacccatcatcttagatttggttctccttgctgaactcagcaccaggatccagctcaaagctgatgatgaggggaaattccattccttccacccagtggctaccattctcagttacctaaccaaggctcctcttgttccaccaggcactccagtggtgaatgcactgtcaaagcagcgtgcaatgcttgagaacatactgagggcttgtgttggtctggctcctgagaacaacatgattttggaatacaagtgaaattatagctctaagggagaagagtggctgcaatttctttgatcatatatgtattccctctctgtgcagtaatgtaatgctgggagatgaatggtcgtcagtttttctattttatcttttctagatggtgcttataattatgaatatatgtattaagcacctctttttgtgattgaaaattatagacaatgaaaacagaagtgtctttcagtaaaagatggtttac

SEQ ID NO: 458 - DNA, 1746 bp, Flaveria
acatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaactaaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcttcaactatcagagttgggtccttcaatggagaggagatctttgcccctttcaagagcctcctcccaatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggacaacgtgatcaagggaaccaaaaatgaacaaatccaaaagatcattaaggacatcagggagtttaaggaggctaacaaggtagacaaagtggtggtcctgtggactgctaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccgacatccatcgtgagctacaatcacttgggaaacaatgacgggatgaacctctcagccccacaaacattcagatccaaggagatctccaagagcaatgttgttgatgacatggtttccagcaacgccatcttatacgagcccggggagcatcctgaccatgtggtcgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcgttccatccggtggcaacgattctgagttacctcacaaaggcccctcttgtaccaccagggacaccagtggtgaatgcgctcgcaaagcagagggcaatgctggagaacatactgagggcttgtgttggattggcaccagaaaacaacatgatcttggaatacaagtgaagtgagcatgtgatgacgtgcatgccgtatgatatatgattgttttttatttggttttcgttttcaaatgtaattcgtgtgcttagctttatggaagtatttatttggaggtgaatatatcccaaaataagccaaattttgtggtgaatatgcatccattagtcgcttacacgcgtcaaatagttgtatggaatttaatccctcctaatgt

SEQ ID NO: 459 - DNA, 1844 bp, Flaveria
acacacacacacacacacacacccttttgagtttcttcttctttcatcatcagccaatatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaacgcaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcttcaactatcagagttgggtccttcaatggagaggagatctttgcccctttcaagagcctcctccctatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggataacgtgatcaagggaaccaaaaatgaacaaatccaaaagatcattaaggacatcagggagtttaaggaggctaacaaggtagacaaagtggtggttctgtggactgccaacacagaaagatacagcaatgtaatggttgggcttaatgacacaatggaaagcctgtttgcatcattagacaaaaatgaagctgagatctcaccatcgaccttgtatgctattgcttgtattcttgaaaacgtgccattcatcaatggaagcccacaaaacactttcgtaccaggggtaattgatttggctatcaaaagaaacagcttgattggtggagatgactttaagagtggtcaaaccaagatgaagtctgttcttgttgattttcttgttggagctggcatcaagccgacatccatcgtgagctacaatcacttgggaaacaatgacgggatgaacctctcagccccacaaacattcagatccaaggagatctccaagagcaatgttgttgatgacatggtttccagcaacgccatcttatacgagcccggggagcatcctgaccacgtggttgtcatcaagtatgtgccatacgtcggagatagcaaaagggcaatggatgagtacacatctgagatattcatgggtggtaaaagcacaatcgttctacacaacacgtgtgaggactccctgttggctgctccaatcatcttggacttggtcctgctcgctgagctcagtactcgcatccagctcaaagctgaagatgagggtaagttccattcattccatccggtggcaacgattctgagttacctcacaaaggcccctcttgtaccaccagggacaccagtggtgaatgcgctcgcaaagcagagggcgatgctggagaacattctgagggcttgtgttggactggcaccagaaaacaacatgatcttggaatacaagtgaagtgagcatgtgatgacgttcatgccgtatgatatatgattgttttttatttggttttcgttttcaaatgtaattcgtgtgcttagctttatggaagtatttatttggaggtgaatatatcccaaaataagccaaattttgtggtgaatatgcatccattagtcgcttacacgcgtcaaatagttgtatggaatttaatccctcctaatgttttaagtttgttggtaataccaaaattaatatatgttctcgt

SEQ ID NO: 460 - DNA, 1710 bp, Flaveria
acacacacacacacaccctttgagtctcttctttcatcatcatcatcagccaacatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaactaaaactcgtgtccctaaactaggggttatgcttgttggatggggaggaaacaatggctccacgctaaccgccggtgttatcgcgaatcgggagggaatatcttgggcaaccaaagagaaagtgcaacaagccaactactttggctccttgactcaagcatcaactatcagagttgggtccttcaatggagaggagatctttgcccctttcaagagcctcctcccaatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggacaacgtgatcaagggaaccaaaaatgaacaaatccaaaagatcattaaggacatcagggagtttaaggaggcaaacaaggtagacaaagtggtggtcctgtggactgctaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccaacatccatcgtgagctacaatcacttgggaaacaatgacgggatgaacctctcagccccacaaacattcagatccaaggagatctccaagagcaatgttgttgatgacatggtttccagcaacgccatcttatacgagcccggggaacatcctgaccatgtggtcgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcattccatccggtggcaacgattctgagttacctcacaaaggcccctcttgtaccaccagggacaccagtggtgaatgcgctcgcaaagcagagggcgatgctggagaacatactgagggcttgtgttggattggcaccagaaaacaacatgatcttggaatacaagtgaagtgagcatgtgatgacgtgcatgccgtatgatatatgattttttttatttggttttcgtttttcaatgtaattcgtgtgcttagctttatggtaagttatttatttggaggtgaatatatcc

SEQ ID NO: 461 - DNA, 1847 bp, Flaveria
gatcatcagccaatatgttcatcgagagctttaaggtcgaaagccccaacgttaagtacactgaggatgaaattcactctctgtacaattacgacaccactgagctccttcacgaggagaaagacggtgcttatcaatgggttgttaagcccaaaaccgtcaaatacgagttcaaaactcaaactcgtgtccctaaactaggggttatgcttgttggatggggaggtaacaatggctccacgctaactgccggtgttatcgctaatcgggagggaatatcttgggcaaccaaagagaaagtgcaacaagccaactactttggctccttgactcaagcatcaactatcagagttgggtccttcaatggagaggagatctatgcccctttcaagagcctcctcccaatggtgaacccagatgacatagtgtttgggggatgggacataagcagcatgaacttggctgatgccatggctagagccaaggttttggacattgatctccaaaagcaattaaggccttacatggaatccatggtcccactccctggtatctatgaccctgacttcattgctgcaaaccaaggtgaacgtgcggacaacgtgatcaagggaaccaaaaatgaacaaatccaaaagatcattaaggacatcagggagtttaaggaggctaacaaggtagacaaagtggtggttctgtggactgccaacacagaaagatacagcaatgtaatggttgggcttaatgacacaatggaaagcctgtttgcatcattagacaaaaatgaagccgagatctcaccatcgaccttgtatgctattgcttgtattcttgaaaatgtgccattcatcaatggaagcccccaaaacactttcgtaccaggggtaattgatttggctatcaagagaaacagtttaattggtggagatgactttaagagtggtcaaaccaagatgaagtctgttcttgttgacttccttgttggagctggcatcaagccaacatccatcgtgagctacaatcacttgggaaacaatgacggaatgaacctctcagccccacaaacattcagatccaaggagatctccaagagcaatgttgttgatgacatggtttccagcaatgccatcttgtacgagcctggggagcatcctgaccatgtggtcgtcatcaagtatgtgccatacgtcggagatagcaagagggcaatggatgagtacacatctgagatattcttgggcggtaaaagcacaatcgttctacacaacacatgtgaggactcgctgttggcagctccaatcatcttggacttggtcctgctcgctgagctcagtactcgcatccagctcaaagctgaagatgagggtaagttccattcgttccatccggtggcaacgattctgagttacctcacaaaggcccctcttgtaccaccagggacaccagtggtgaatgcactagcaaagcagagggcaatgctggagaacatactgagggcttgtgttggattggcaccagaaaacaacatgatcttggaatacaagtgaagtgagcatgtgacgaagtgcatgccgtatgatatgtgattgttttttatttggtttttgtttcgaaatgtaatgcgtgtgcttagctttatggaaatatttatttggaggtgaatgtatcccaaaataagccaaattttgtggtgaatatgcatccattagtcgcttacacgcgtcaaatagttgtatggaatttcatccctcctaatgtttcaagttgttggtaataccaaaaataataaatattctcgttcaataaatttaatatataatgtgatatataagatggttatatatgag

SEQ ID NO: 462 - DNA, 1703 bp, Flaveria
tcctacccttccaactcacacgacagtacaacacacacacacacacacacacacccctttgagtttcttctttcattcatcatcagccaatatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaacgaaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcatcaactatcagagttgggtccttcaatggagaggagatctttgcccctttcaagagcctcctcccaatggtgaacccagatgacatagtgtttgggggatgggacataagcagcatgaacttggctgatgccatggctagagccaaggttttggatattgatctccaaaagcaattaaggccttacatggaatccatggtcccactacctggtatctatgaccctgacttcattgctgcaaaccaaggtgaacgtgcggacaacgtgatcaagggaaccaaaaatgaacaaatccaaaagatcattaaggacatcagggagtttaaggaggcaaacaaggtagacaaagtggtggtcctgtggactgctaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccaacatccatcgtgagctacaatcacttgggaaacaatgacgggatgaacctctcagccccacaaacattcagatccaaggagatctccaagagcaatgttgttgatgacatggtttccagcaacgccatcttatacgagcccggggaacatcctgaccatgtggtcgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcattccatccggtggcaacgattctgagttacctcacaaaggcccctcttgtaccaccagggacaccagtggtgaatgcgctcgcaaagcagagggcgatgctggagaacatactgagggcttgtgttggattggcaccagaaaacaacatgatcttggaatacaagtgaagtgagcatgtgatgacgtgcatgccgtatgatatatgattgtttttatttggttttcgttttctaatgtaattcgtgt

SEQ ID NO: 463 - DNA, 2176 bp, Poplar
aaggggcaaatgaaaacgaaggtaaggtggggtccgcctatgcccacatccattaacatgcagacacgcgtctctcgtttctctatttattcaccgctcagggtggctcttgacagagcacgaaaggaaggaagaaagggtgggaagctgataaaagagagtagttgtctttgcaatctcggtcttgggttccattcttgattccacattgttttatttagctagcaagcaaagaaagcaaaaatgtttattgagaagtttaaggttgagagtcctaacgttaagtacactgaagatgagattcactccgtgtacaactacgaaactactgaacttgttcatgagaacaagaacggttcttatcagtggactgtcaagcccaaaactgtccaatatgaattcaagactgatattcatgtccctaaactaggtgttatgcttgtggggtggggcggaaacaatggttcaactctcactggtggtgttattgccaacagagaaggaatctcctgggcaactaaggacaaggtgcaacaagccaattactttggctcacttacccaggcatcaagtatcagagttgggtccttcaatggagaggagatttatgctccattcaagagcctgctccccatggtgaacccagatgatattgtatttgggggatgggacataagtgacatgaacttagcagatgccatggcgagggccaaggtattcgacattgacttgcaaaagcaattgaggccctacatggaatccatggcgccactccctggaatttacgaccctgatttcattgctgccaatcaaggctcacgtgctaacaatgttatcaaaggcactaagaaagaacaagtccagcaaattatcgaagacattagggagttcaaggagaaaaacaaggtggacaaggtggttgtgttgtggactgccaacacagagaggtacagtaatattgttgtggggctgaatgacaccatggagaacctcttggctgctgtggagaaggatgaatcagagatatccccatcaaccttgtatgctctggcttgcatttatgaaaatattcctttcataaatggaagcccacagaacacttttgttccaggacttgttgatttggctattaagaggaacagtttgattggtggagatgactttaagagtggtcagaccaagatgaaatctgttctggttgatttccttgttggggccggtattaagccaacgtcaatagtgagttacaaccatctgggaaacaatgatggcatgaatctatcagcacctcaaacttttcggtctaaggaaatctccaagagcaatgttgttgatgacatggtctctagcaatggcatcctctatgagcctggtgaacaccctgatcatgttgtagtaatcaagtatgtgccatatgttggagatagcaagagagctatggatgagtacacctcggagatattcatgggtgggaaaaacactatagtgctgcacaacacctgtgaagactccctcttggctgcaccaatcatcctcgacttggttcttcttgcagaacttagcacaaggatccagctcaaaggcgaagcagagggcaagtttcactctttccacccagttgctactattctcagttacctcacaaaggctcctcttgttccaccaggcacaccagtggtgaatgcactgtcaaagcaacgtgcaatgcttgagaacatccttagagcttgtgttgggttagctcctgagaacaacatgattttggaatacaagtgagctagtagaagataacagtggaagaagattggtctaggaactaaaacagacaaccatttttcctttctctttcactaatcctgtggttaagagatgctttttccatatatataaatgtaatagttgtgtgatattaatgttatgtatggagtttgttgtttatttcatgtagcccgtttgctctggttctctgatgaccaagcacctctttctattggaaaaggaaagtatgcatgtaaactgttcataaactgtgtttatcacagcgaagtcgtgtagttatttcagtgcataccattaaactatagttttcttcccttctgaactcttcttcttcaaattaaaactactagcgagtatgaattcatgatttgtttagtttataatcatggtaattttg

SEQ ID NO: 464 - DNA, 2106 bp, Clementine
atgcacagattaccaagctagtttcgaaagttaaaagagtgttgagtcgagtgggaagtgagaattgagaaggagagtcgagttcggagacagcaagacgaaacagctcttcttccaataaatctcaaagcatttgtttggttttatttaaagcaattttctcagcaaactcttcttctaataaattttaaagcatttgtttggtttttatttaaagcaattttctcagcgaagttttcaattttttctctaaaattttcctgggaaaatgtttatcgaaaatttcaaggttgagagcccaaatgtgaagtacacagataatgagattcactctgtgtacgattatgaaaccactgagcttgttcatgagaacagaaatggcacttatcagtggattgtcaagcccaaaactgtcaaatatgagttcaaaaccgatgttcatgtccctaaacttggggttatgcttgtgggttggggtggaaacaacggctcaactctcacgggtggtgttatcgcgaatcgagagggaatctcctgggccacaaaggacacagtgcaacaagccaattattttggttcacttacccaagcatcagcaattagagttgggtcttacaatggagaggagatttatgctccattcaagagcattctccctatggtgaacccagatgacattgtgtttggaggatgggacattagtgacatgaacttggctgatgccatggccagggctagagtgtttgatattgatcttcaaaagcaacttaggccttacatggaatcaatggtcccacttcctggaatctatgaccttgatttcattgctgccaatcaagggtcccgtgccaacaacgtgatcaaaggaaccaagaaagaacaaatgctacaaatcatcaaagatattagagagtttaaggagaaaaacaaggtggatagggttgttgtactgtggactgctaacactgagaggtacagtaatgtgattgttgggctaaatgacacagtggagaaccttcttgcttcactggacaaaaacgaagctgagatttctccttccaccttgtatgctattgcttgtgttcttgaaaatatccctttcatcaatggaagcccccaaaacacctttgtaccagggcttattgacttggctattaggaggaactgtttgattggtggagatgacttcaagagtgggcagactaagatgaaatctgttttggttgatttccttgttggggcaggaatcaagccaacatcaattgttagctacaaccacttgggaaacaatgatggaatgaatctttcagcccctcaaaccttccgctccaaggagatttccaaaagtaatgttgttgatgacatggtctccagcaatggtatcctttatgggcctggtgaacaccccgaccacgttgtggtcatcaagtatgtgccatatgttggcgatagcaagagagccatggatgagtacacatcagaaattttcatgggtggcaagaacaccattgtgctgcacaacacgtgtgaggactctcttttggctgctccaatcgttctagatttggttctgctggctgaactcagcaccaggatccagctcaaagctgaaggagagggcaaattccactctttccaccctgtggctacaattctcagctacctcaccaaggctcctctggtccctccaggcacaccagtggtgaatgcgctgtcgaagcagcgtgcaatgcttgagaacattctgagggcttgcgttggcttggctcctgagaacaacatgattttggaatacaagtgaagaacttgcaggggagaaaagtggaagaaccggttttccctttctctgtcaccaatcaaagctgtggtggtccatttaattactgattgtaatgtcttgtgtcatgaaattgtggttaatattagtgtgtcctgtatgtttgctcttttatttttttaatgaaggtgctggagtgtagcccattgcctttgtagctcatttcggagcatgaaatctcttgtattgcaagtagataatatatggaagttcataaataactgtattgcggcaaatttgaatctcatctaaatccttacttcttaact

SEQ ID NO: 465 - DNA, 2095 bp, Coffea
cctttggggaggccattacggccgggggagagattacacacaccttacacacttgagagtgagagagcggtgttctaggagttcagttgaaggcagggagagattgagaggaaaatttgaagaaaaatcagttaaaaggactcctttctggagtcctaaaattgtgggttttttttgtttccccattttttcttctcagctcaattctttccttcgcctttcttgctctgtctccctctgcctcacgagtgttgttgaaattgtagcgtggtttgtctgacatttgtttatttgttgtaattaaagatgtttatcgagaactttaaggttgacagccccaatgtgaagtactccgagagtgagattcactctgtttataactatgaaaccaccgaacttgttcatgagaacagagacggtacttatcagtggattgtcaagcccaaatctgttcaatatgagttcaggactgatattcatgtccccaaattaggggttatgcttgtggggtggggagggaacaatggttcaactctgacaggaggcgtcattgcaaacagggagggaatttcttgggcgaccaaggacaaagtgcaacaagcaaattacttcggctctcttacccaggcatcttccataagggttggatccttcaatggagaggagatctatgccccattcaagagcctccttcccatggtcaacccagaagacattgtttttggtgggtgggacataagcaacctgaatttggctgatgccatggccagggctaaggtcttagatattgatctacagaaacaattgaggccctacatggaatccatggtccctctccctggtatctatgaccctgatttcattgctgctaatcaaggctcacgtgctaacaacttgatcaaaggaaccaagaaagaacaagttgaacaagttattaaggatattagggagtttaaggagaagaacaaggtggacaagattgttgtcttatggaccgctaacacagagagatacagcaatgttgctgttggccttaatgacacgacggaaaatcttcttgctgctttggacagaaatgaggctgagatttcaccctccaccttgtatgctatagcttgcatgtatgaaaatgtcccttttataaacgggagccctcagaacacctttgtcccaggtttgattgatttggccattaagaggaactgtttgattggtggagatgacttcaagagtgggcagacaaagatgaaatctgtgcttgttgatttccttgtgggggctggtatcaagccaacttcaattgtgagctacaaccatttggggaacaatgacggcatgaatctttctgcccctcaaacttttaggtccaaggagatctccaaaagcaatgtggtggatgacatggttgccagcaatggtatcctttatgaacctggggagcaccctgaccatgttgttgtcattaagtatgtgccatatgttggagacagcaagagagccatggatgaatacacatcagaaatatttatggggggaaagagcactatagtgttgcacaacacttgtgaagactctcttttggctgctccaatcatcttggatcttgtcctccttgctgaacttagcactcgcattcagctcaaagctgaaggagagggaaagttccactccttccaccctgtggccacaattctcagctatctctctaaagcccctcttgtaccaccaggcacaccagtggtgaatgcactttcaaaacagagggcaatgctagagaacatattgagggcttgtgttggactcgcaccagagaacaacatgattttggaatataaatgaagaatttgcatccatctgatttatggatgtttagcaacagattcatagtaaggaaaattagttccgtgctgtttgttcaaggaaccatcctttctttccttttttttttttttttttcttcctctttttgttatttttaatcctttgtaagctagtatgtcatgtgtcaatgtcttcttttgaagatgcaatattctggtcatttactgtgtaatttggctggtaattaagataatgtctttcagttgttgatccc

SEQ ID NO: 466 - DNA, 1816 bp, Flaveria
tttcattcatcatcatcagccaacatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaactaaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcatcaactatcagagttgggtccttcaatggagaggagatctttgcccctttcaagagcctcctcccaatggtgaacccagatgacatagtgtttgggggatgggacataagcagcatgaacttggctgatgccatggctagagccaaggttttggacattgatctccaaaagcaattaaggccttacatggaatccatggtcccactccctggtatctatgaccctgacttcattgctgcaaaccaaggtgaacgtgcggacaacgtgatcaagggaaccaaaaatgaacaaatccaaaagatcattaaggacatcagggagtttaaggaggctaacaaggtagacaaagtggtggttctgtggactgccaacacagaaagatacagcaatgtaatggttgggcttaatgacacaatggaaagcctgtttgcatcattagacaaaaatgaagccgagatctcaccatcgaccttgtatgctattgcttgtattcttgaaaatgtgccattcatcaatggaagcccccaaaacactttcgtaccaggggtaattgatttggctatcaagagaaacagtttaattggtggagatgactttaagagtggtcaaaccaagatgaagtctgttcttgttgacttccttgttggagctggcatcaagccaacatccatcgtgagctacaatcacttgggaaacaatgacggaatgaacctctcagccccacaaacattcagatccaaggagatctccaagagcaatgttgttgatgacatggtttccagcaatgccatcttgtacgagcctggggagcatcctgaccatgtggtcgtcatcaagtatgtgccatacgtcggagatagcaagagggcaatggatgagtacacatctgagatattcttgggcggtaaaagcacaatcgttctacacaacacatgtgaggactcgctgttggcagctccaatcatcttggacttggtcctgctcgctgagctcagtactcgcatccagctcaaagctgaagatgagggtaagttccattcgttccatccggtggcaacgattctgagttacctcacaaaggcccctcttgtaccaccagggacaccagtggtgaatgcactagcaaagcagagggcaatgctggagaacatactgagggcttgtgttggattggcaccagaaaacaacatgatcttggaatacaagtgaagtgagcatgtgacgaagtgcatgccgtatgatatgtgattgtttttatttggttttgtttcgaaatgtaatgcgtgtgcttagctttatggaaattatttatttggaggtgaatgtataccaaaatagacctaaattttgtggtgaatatgcatccattagtcgcttacacgcgtcaaatagttgtatggaatttcatccctcctaatgtttcaagttgctggtaataccaaaattataaatattctcgttcaataaa

SEQ ID NO: 467 - DNA, 1710 bp, Flaveria
gaggagggcagccaaacaacctcactacacacacgcaacacacacctttcgagtctcttctttcatcatcatcatcagccaacatgttcatcgagagctttaaggtcgaaagccccaacgtcaagtacactgatgatgaaattcactctctgtacaactacgacaccactgaactcattcacgaggagaaaaacggtgcttatcaatgggttgttaagcccaaaaccgttaaatacgagttcaaaactaaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcttcaactatcagagttgggtccttcaatggagaggagatctttgcccctttcaagagcctcctcccaatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggacaacgtgatcaagggaaccaaaaatgaacaaatccaaaagatcattaaggacatcagggagtttaaggaggcaaacaaggtagacaaagtggtggtcctgtggactgctaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccaacatccatcgtgagctacaatcacttgggaaacaatgacgggatgaacctctcagccccacaaacattcagatccaaggagatctccaagagcaatgttgttgatgacatggtttccagcaacgccatcttatacgagcccggggaacatcctgaccatgtggtcgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcgttccatccggtggcaacgattctgagttacctcacaaaggcccctcttgtaccaccagggacaccagtggtgaatgcactagcaaagcagagggcaatgctggagaacatactgagggcttgtgttggattggcaccaggaaacaacatgatcttggaatacaagtgaagtgagcatgtgacgaagtgcatgccgtatgatatgtgatgtttttatttggttttgttttcgaaatgtaatgcgtgtgcttagctttatggaa

SEQ ID NO: 468 - DNA, 2107 bp, Orange
atacacagattaccaagctagtttcgaaagttaaaagagtgttgagtcgagtgggaagtgagaattgagaaggagagttgagttcggagacagcaagacgaaacagctcttcttccaataaatctcaaaagcatttgtttggttttatttaaagcaattttctcagcaaactcttcttctaataaattttaaagcatttgtttggtttttatttaaagcaattttctcagcgaagttttcaattttttctctaaaattttcctgggaaaatgtttatcgaaaatttcaaggttgagagcccaaatgtgaagtacacagatcatgagattcactctgtgtacgattatgaaaccactgagcttgttcatgagaacagaaatggcacttatcagtggattgtcaagcccaaaactgtcaaatatgagttcaaaaccgatgttcatgtccctaaacttggggttatgcttgtgggttggggtggaaacaacggctcaactctcacgggtggtgttatctcgaatcgagagggaatctcctgggccacaaaggacactgtgcaacaagccaattattttggttcacttacccaagcatcagcaattagagttgggtcttacaatggagaggagatttatgctccattcaagagcattctccctatggtgaacccagatgacattgtgtttggaggatgggacattagtgacatgaacttggctgatgccatggccagggctagagtgtttgatattgatcttcaaaagcaacttaggccttacatggaatcaatggtcccacttcctggaatctatgaccctgatttcattgctgccaatcaagggtcgcgtgccaacaacgtgatcaaaggaaccaagaaagaacaaatgctacaaatcatcaaagatattagagagtttaaggagaaaaacaaggtggatagggttgttgtactgtggactgctaacactgagaggtacagtaatgtgattgttgggctaaatgacacagtggagaaccttcttgcttcactggacaaaaacgaagctgagatttctccttccaccttgtatgctattgcttgtgttcttgaaaatatccctttcatcaatggaagcccccaaaacacctttgtaccagggcttattgacttggctattaggaggaactgtttgattggtggagatgacttcaagagtgggcagactaagatgaaatctgttttggttgatttccttgttggggcaggaatcaagccaacatcaattgttagctacaaccacttgggaaacaatgatggaatgaatctttcagctcctcaaaccttccgctccaaggagatttccaaaagtaatgttgttgatgacatggtctccagcaatggtatcctttatgggcctggtgaacaccccgaccacgttgtggtcatcaagtatgtgccatatgttggcgatagcaagagagccatggatgagtacacatcagaaattttcatgggtggcaagaacaccattgtgctgcacaacacgtgtgaggactctcttttggctgctccaatcgttctagatttggttctgctggctgaactcagcaccaggatccagctcaaagctgaaggagagggcaaattccactctttccaccctgtggctacaattctcagctacctcaccaaggctcctctggtccctccaggcacaccagtggtgaatgcgctgtcgaagcagcgtgcaatgcttgagaacattctgagggcttgcgttggcttggctcctgagaacaacatgattttggaatacaagtgaagaacttgcaggggagaaaagtggaagaaccggttttccctttctctgtcaccaatcaaagctgtggtggtccatttaattactgattgtaatgtcttgtgtcatgaaattgtggttaatattagtgtgtcctgtatgtttgctcttttatttttttaatgaaggtgctggagtgtagcccattgcctttgtagctcatttcggagcatgaaatctcttgtattgcaagtagataatatatggaagttcataaataactgtattgcggcaaatttgaatctcatctaaatccttacttcttaact

SEQ ID NO: 469 - DNA, 1699 bp, Sunflower
aaaacatagaaaatgtttatcgagagctttaaggttgaaagccccaatgtcaagtacagtgaggatgaaattcactctttgtacaattacgacaccacggagcttgttcacgaggagaaaaacggtgcttatcaatgggttgttaagccaaaaactgttaaatacgagtttaaaacccaaactaatgttcctaagctaggggttatgcttgttggatggggaggcaacaatgggtctaccctaactgcgggtgttatcgctaatcgggagggaatctcttgggcaactaaagaaaaggtgcaacaagccaactactttggttctctgactcaagcatcaaccataagagttgggtcatttaatggagaggagatctatgcccctttcaagagcctcctccctatggtgaacccagatgacatagtgtttgggggatgggacataagcagcatgaacttggctgattccatggccagagccaaggtgttggacattgatctccagaagcagttaaggccttacatggagtccatggtcccactccctggtgtctttgaccccgacttcatcgcagccaaccaaggcgagcgtgctgacaacgtcatcaagggaaccaaaaacgaacagatccaaaagatcattaaggacatcagggagtttaaggaggctaacaaggtagacaaagtggtggtactctggactgcaaacaccgaaagatacagcaatgtaatggtcgggcttaatgacacaatggaaagcctgtttgcatcattggacagaaatgaggcagagatttcaccatccaccttgtatgctattgcttgcattcttgaaaatgtgcctttcattaatggcagcccacaaaacacttttgtaccaggggttattgatttggctatcaagagaaacagcttgattggtggtgatgactttaagagtggtcaaaccaagatgaagtctgttcttgttgacttccttgttggagctggcattaagccaacatccattgtgagctacaatcacttgggaaacaacgacggaatgaacctctcggccccacagacattcagatccaaggagatctccaagagcaatgttgttgatgacatggtttcaagcaacgccatcttgtacgagcccggggagcatcccgaccatgtggtcgtcatcaagtacgtgccatacgtcggagacagcaagagagcaatggacgagtacacgtctgagatattcatgggcggtaaaagcacaatcgtcctacacaacacatgtgaggactctctgttggccgctccaatcatcttggacttggtcctccttgctgagctcagtacccgcatccaacttaaagctgaaaccgagggtaagttccattcgttccatccggtggctacgattctgagctaccttacaaaggcccctctggtgccgccgggtacaccagtggtgaatgcgctagcgaagcagagggcgatgctcgagaacataatgagggcatgtgttggattggcaccagaaaacaacatgatcttggagtacaagtgatctatctgggcatggctggcttatttaaattatcaatacgttatttgcattttcaaatgtaacgtctgtcctgtgctgtgctttgctagtttgctttgttgttaaaagtatttatttggagatgaatatatctcaaaataaaccctagtttttt

SEQ ID NO: 470 - DNA, 1818 bp, Tobacco
ggagtgcaaataggattctaaacatttgttctgtgttcttgttttcttaattgaaaaatttcttagatttgttctgataaggtgtttgacaaaatgtttattgagaattttaaggttgaaagcccaaatgtgaaatacacagaaaatgagattcgctctgtgtatgattatcaaaccacagagcttgttcatgaagagaaaaatggttcttatcaatggactgtcaagccaaaatgtgtcaaatatgagttcaaaactgataccaatgttcccaaattaggggttatgcttgttggatggggaggaaacaatggttcaactttgacaggaggtattattgctaataaagaaggaatttcatgggcaacaaaagagaaggtgcaacaagccaattactttgggtctcttactcaggcatcaacaattagagttggatctttcaatggagaagagatctatgcccctttcaagagcctccttcccatggttaatccagatgatgtagtatttggaggatgggacattagcaacatgaatttggcagatgctatggtcagggctaaggttttcgacattgatctgcaaaaccagctgaggccatacatggaatcaatggtcccccttcccggtatctatgaccctgacttcattgctgctaaccaagaatcacgcgccaacaacgtgatcaaaggaaccaagaaagaacaagttgatcaaattgttaaagatattagggagttcaaggagaagaataaggtagacaagattgtggtgctgtggacagccaacactgaaagatacagcaatgtgattgtaggacttaatgacacaatggaaaaccttttggctgctgtggatagagatgaagctgaaatatctccttctacattgtatgctattgcttgtgttcttgaaaatgtgccttttatcaatggaagtccacagaacacttttgtcccaggtctaattgatttggccataaagaggaacactttgattggtggtgatgactttaagagtggtcaaaccaagatgaagtcagtgctggttgatttcctagttggagccggtattaagccaacatcaattgtgagctacaatcacctgggtaacaatgatggaatgaatctttccgcccctcaaactttccggtctaaggagatctcgaagagcaatgttgtcgatgacatggtttccagcaacgccattctctatgaagctggcgagcatcctgaccatgttgttgtgatcaagtatgtcccctatgttggagatagtaagagagcaatggatgagtacacatcagagattttcatgggtggaaagaacacaatagttttgcacaacacttgtgaggattctcttttggcagctccaattatattagacttggtccttctcgccgaactcagcactcgcattcagctcaaagctgaaggagaggggaagttccattctttccatcctgtggctactatactcagctacctcacaaaggctcctctggtaccaccaggtacaccagtggtgaatgccctgtcaaagcagagggcaatgcttgagaatatactgagagcttgtgttggtttggcaccagagaacaacatgattttggaatacaaatgaaaatgcagatgaaggaaattaatagaagagaatggactcaagattagttgcatgtgctgaagatcattttctcttctttttccttttctattttctcatcaatatataattaagcaaagtgtgccaattttcgttttagtaaatctactttgccttttcttttgtacgagttagattttatgcactgacgtt

SEQ ID NO: 471 - DNA, 1788 bp, Ambrosia
acctcctcacacacttctcttattctctctctctctctaatattcaattgtgtttcttttttttattattatttgaacaaaatgtttattgagagctttaaggtagagagccctaatgtcaaatacacagaggatgaaatacactctctgtataattacgacaccacggagcttgttcacgaagagaaaaacggggcttatcaatgggttgttaagcccaaaaccgttaaatatgagtttaagacccaaaccaatgttcctaaactaggggttatgcttgttggatggggaggtaacaatggctccacacttactgcgggtgttatcgctaatcgggagggaatctcttgggcaactaaagagaaggtgcaacaagccaactactttggatctctaactcaagcatcaacaattagagttggctcatacaatggagaggagatctatgcccctttcaagagcctcctccctatggtgaaccctgatgacatagtgtttgggggatgggacataagcagtatgaacttggctgattccatggccagagctaaggtgttggacattgacctacaaaagcagttgaggccttacatggaatccatggtcccactccctggtatcttcgaccccgacttcatcgctgcgaaccaaggcgagcgtgccgataatgtgatcaagggaaccaaaaatgaacaaatccaaaaggtcattaaggacattagggagtttaaggaggctaacaaggtagacaaagtggtggttctatggacggccaacacagaaagatacagcaatgtcatggttgggcttaatgatacaatggaaagtctttttgcatcattagacagaaacgaggctgagatttcgccatccaccttgtttgctattgcttgtattcttgaaaatgtgcctttcatcaatggcagcccacaaaacacttttgtaccaggggttattgatttggctatcaagagaaacagcttgattggtggtgatgacttcaagagtggtcaaaccaagatgaagtctgtgcttgttgacttccttgttggagctggcataaagccaacatccattgtgagctacaatcacttgggaaacaatgacggaatgaacctttccgcgccacagacattcagatccaaggagatctccaagagcaatgttgttgatgacatggtttcgagcaatgccatcttatacgagcctggggagcatcccgaccatgtggtcgtcatcaagtatgttccatatgttggagacagcaagagagcaatggacgagtacacgtccgagatattcatgggtggtaaaagcacaatcgtcctacacaacacatgtgaggactctctgttggccgctcctatcatcttggacttggtcctccttgctgagctcagtacccgtatccaactcaaagctgaaaccgagggtaagttccattcgttccatccggtggccacaattctgagttaccttacaaaggcccctctagtaccgccagggacaccagtggtgaacgcgctagcgaagcagagggcgatgctggagaacataatgagagcatgtgttggattggcaccagaaaacaacatgatcttggagtacaagtgatggatgggggcatggcttatttattttataaatacgttatttgcttttttgttcaaatgtaacgtgtgtgatgtgatgtgctatgctttgctttgctttgtttcttctagtatttatttggagatgaatatatcccaaaataaacccaagtttttgtggtgaatatgcattgca

SEQ ID NO: 472 - DNA, 1547 bp, Cirsium
aagaagccatgtttatcgagagctttaaggtggaaagccccaatgttaagtacactcccgatgagatacactcgctgtacaattacgataccaccgagctcgttcacgaggagaaggatggggccttccaatgggtcgttaagcctaaaaccgtcaaatacgagttcaagactcaaactcatgttcctaaattaggggtgatgcttgtcggatggggaggtaacaatggctcaaccctaactgctggtgttatcgctaatcgagagggaatatcttgggcaaccaaagacaaagtgcaacaagccaactactttggttccttgacccaagcatccactatcagagttgggtcattcaatggggaggagatctatgcccctttcaagagcctactcccaatggtgaaccctgacgatatcgtttttggaggatgggacataagtagcatgaacttggcagattccatggcaagggccagggttttggacattgatctccaaaagcagttaaggccttacatggaatccatggtcccactccctggtatctttgaccctgacttcattgctgccaaccaaggttcacgtgccgacaacgtgatcaagggtaccaagaatgaacagatccaaaaaatcatcaaggacatcagggagtttaaggaggcaaacaaggtggataaagtggtggtactgtggacagccaacacagaaagatacagcaatgtagtagttgggctgaatgatacaatggagaatctctttgcatcaatagacaagaatgaagctgagatttctccatcaaccttgtatgctatcgcttgtattcttgaaaatgtgcctttcatcaatggcagcccacagaacacttttgtaccaggggttattgatttggccatccagaggaacaccttgattggtggagatgactttaagagtggtcaaaccaagatgaaatctgttcttgttgatttccttgtgggagctggtattaagccaacatcgatcgtgagctacaatcacttgggaaacaatgacgggatgaacctgtcagctccacaaacattccgttccaaggaaatctccaagagcaacgttgttgacgacatggtttcaagcaatgccatcttatacgagcctggggagcatcctgatcatgtcgtagttatcaagtatgtgccgtatgtgggagatagcaagagagcaatggacgagtacacgtctgagatattcatgggtggtacaaacactatcgttctgcataacacatgtgaagactcactgttggctgcaccaatcatcttggacttggtcctactggctgagctgagtactcgcatccagcttaaagcggaaagtgagggcaagttccactccttccatccggttgcaaccatcctaagttacctcacaaaggcccctcttgtgccaccagggacaccagtggtgaatgcactagcaaaacagagggcaatgctggagaacatactgagggcatgtgttggattggcaccagaaaacaacatgatcttggaatacaagtgaagtcaa

SEQ ID NO: 473 - DNA, 1895 bp, Euonymus
gggggaggtgcgctaggaattgagattgaggagctaagcttagtctttttgttttgctcaatttcttgcgaaatactcattttttatttactgagcaaaaatgtttattgagaattttaaggttgagagtcctaatgtgaagtacacagagactgagattcattctgtgtacaactatgagaccacagagcttgttcatgagaacaagaatggctcatatcaatggactgtcaaacccaaaactgtcaaatacgaattcaagaccgacaccagtgtccctaaactaggggttatgcttgtgggatggggaggaaacaacggttcaaccctcaccggtggtgttatagcaaaccgagaaggaatctcttgggcaaccaaggacaaggtgcagcaagccaactactttggctcactaacccaggcatcatcaattcgagttgggtcttacaatggagaagaggtctatgctccatttaagagccttcttcctatggtgaacccagatgagatagtgtttgggggttgggacataagtgacatgaatttggctgatgccatggccagggctaaggtttttgatattgatttgcaaaagcagctaatgccctacatggaacatatgatcccactccctggaatctatgatcccgatttcattgctgccaatcaagactcacgtgccaacaacattatcaaaggcactaagaaagaacaagttcaacaagttatcaaagacattagggaattcaaggaaaaaaccaaagtggacaaggtggttgtgctgtggactgccaacacagaaagatacagtaatgtaattgtgggcttaaacgacactattgagaatctgtttgcttctttggacaaagatgaagcagagatttctccttccaccttgtatgctttggcttgtattcttgagaacattcctttcatcaatggaagcccacagaacacttttgttccaggattaattgatttggccataaagaggaacagtttgattggtggagatgactttaaaagtggtcagaccaaaatgaaatctgtgctggttgatttccttgttggggctggcatcaagccaacatcaattgtgagctacaaccatttgggaaacaatgatggcatgaatctctcagcaccccaaaccttccgatccaaagaaatctccaagagtaatgtcgtggatgacatggttgcaagcaatggtatcctcttcgagccgggcgagcatcctgaccatgttgtggtcattaagtatgtgccatatgttggagacagcaagcgagctatggatgagtacacatctgagatattcatgggtgggagaagcacaatagtgctgcacaacacatgcgaggattcactcctggctgcacccatcatcttagatttggttctccttgctgaactcagcaccaggatccagctcaaagctgatgatgaggggaaattccattccttccacccagtggctaccattctcagttacctaaccaaggctcctcttgttccaccaggcactccagtggtgaatgcactgtcaaagcagcgtgcaatgcttgagaacatactgagggcttgtgttggtctggctcctgagaacaacatgattttggaatacaagtgaaattataggtctaagggagaagagtggctacaatttctttgatcatatatgtattccctctctgtgcagtaatgtaatgctgggagatgaatggtcgtcagtctttctattttatattttctagatggtgcttataattatgaatatatgtattaagcacctctttttgtgattgaaaattatagacaatgaaaacagaagtgtctttcagcaaaagatggtttacttactttactcaacatatgagcatacaaaaaaaaaa

SEQ ID NO: 474 - DNA, 1675 bp, Flaveria
acctcacaaacaacacaccctcatctccctcaatcagcagttcaacacacacacacacacacacacacccttttgagtttcttcttctttcatcatcagccaatatgttcatcgagagctttaaggtcgaaagccccaacgtcaagtacactgatgatgaaattcactctctgtacaactacgacaccactgaactcattcacgaaggagaaaacggtgcttatcaatgggttgttaagcccaaaaccgttaaatacgagttacaaacacaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcttcaactatcagagttgggtccttcaatggagaggagatctttgcccctttcaagagcctcctccctatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggacaacgtgatcaagggaaccaaaaatgaacaaatccaaaagatcattaaggacatcagggagtttaaggaggctaacaaggtagacaaagtggtggtcctgtggactgctaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggttattgatttggctatcaaaagaaacagcttgattggtggagatgactttaagagtggtcaaaccaagatgaagtctgttcttgttgattttcttgttggagctggcatcaagccgacatccatcgtgagctacaatcacttgggaaacaatgacgggatgaacctctcagccccacaaacattcagatccaaggagatctccaagagcaatgttgttgatgacatggtttccagcaacgccatcttatacgagcccggggagcatcctgaccacgtggttgtcatcaagtatgtgccatacgtcggagatagcaagagggcaatggatgagtacacatctgagatattcatgggtggtaaaagcacaatcgttctacacaacacgtgtgaggactccctgttggctgctccaatcatcttggacttggtcctgctcgctgagctcagtactcgcatccagctcaaagctgaagatgagggtaagttccattcattccatccggtggcaacgattctgagttacctcacaaaggcccctcttgtaccaccagggacaccagtggtgaatgcgctcgcaaagcagagggcgatgctggagaacattctgagggcttgtgttggactggcaccagaaaacaacatgatcttggaatacaagtgaagtgagcatgtgatgacgttcatgccgtatgatatatg

SEQ ID NO: 475 - DNA, 1992 bp, Monkeyflower
atctcacacacacacagcacacacacaccgccgaagaattcacaagcacactacacacttgtctctcactcccaaaatcttggtgtttgttacatctctctactttctctctctctcctctctctctctctctctctagagacaaatcttgttctgagagaaaacacacacacacacagaaaaatgtttatcgagagctttaaggtagagagcccaaacgtgaagtacacggaggacgatattcagtcagtgtataactatgaaaccacagagcttgttcatgaaagcagaaatggcacttaccagtggattgtcaaacccaagaccgtcaaatatgagttcaaaactgacacccatgttcctaaattaggggttatgcttgttggatggggaggtaacaatggctccacccttactgctggcgtcatcgctaatcgcgagggaatttcatgggcaacaaaggacaaagtgcagcaagcaaattactttggatcactaactcaagcttcctccattagagttggatccttcaatggtgaagagatctacgctccattcaaaagcttgctcccaatggttaacccggacgatgtcgttttcgggggatgggatatcagtgacatgaacctggccgatgcaatgggccgtgccaaggtattggacatcgatctgcagaagcagctccgaccgtacatggaacacatggtcccgctccccggaatctacgatgccgatttcatcgctgccaatcagggctcacgcgccaacaacgtcatcaaaggcaccaagaaggaacaagtccaacaactcatcaaagacattagggagtttaaggagaagaacaaggtggacaggatagtggtactgtggaccgccaacacagagagatacagcaacgttgttgttggtctgaacgacaccatggagaatctcatggcgtcggtggataaaaacgaggccgagatttcgccttcgactctgttcgcaattgcttgtgttctcgagaacatccctttcatcaatggcagccctcaaaacacttttgtaccagggctgattgaaatggctatccagaggaactgtttgattggtggagatgacttcaagagtggtcaaaccaagatgaaatctgtgcttgttgatttccttgttggagctggtattaagccaacatcaattgtgagctacaaccatttaggaaacaacgacgggatgaatttatcggccccacaaactttccgatcaaaggagatttcgaagagcaacgttgtggacgacatggttgctagtaacggcatcctcttcgagcctggggagcaccccgatcacgttgttgttatcaagtatgtgccgtatgtgggagatagcaaacgggcgatggacgagtacacgtcggagatatttatgggagggaagagcactatagtgttgcacaatacgtgcgaagattctcttctcgcagctccgattattctcgatttggtcctcctcgccgagctcagcactcgcattcagctcaaagctgaaggagagggtaaattccacaccttccatcctgtggccactatccttagctatttaaccaaagcccctttggtgccacctggcacgccggtggtgaacgcgctttcgaagcagagggcgatgctggagaatataatgagggcttgtgttggattagcaccagaaaacaacatgattttggagtacaagtgaaggcaatataaaatctgacctgtttaattttcttgctctttttttttaaaaaaaattattattattaaatggaatttctagtattatgtgatatggataagtgttggcgatgtaatatttgtggtcggaattttcgtttcggttttttttttctttttttttttcccgccgtttttagtttcttgtagcgacgacaagttttatcggaaatatatggaaaaaaatattgttggttaacttttgtgaagtttatttatgaaaattttgtattaagaa

SEQ ID NO: 476 - DNA, 1698 bp, Parthenium
ctcacactcttattaatttctctctcttattattattcattttgtgctctttagaaagaaaaaaaatgtttatcgaaaactttaaggttgagagccctaatgttaaatactcagaggatgaaatacactctctgtataattacgacaccacggagcttgttcatgaggagaaaaacggtgcttatcaatgggttgttaagcccaaaaccgttaaatatgagtttaagacccaaactcatgttcctaaactaggggttatgcttgttggatggggaggcaacaatggctccaccctaaccgctggtgtcatcgctaacagagagggaatctcttgggcaactaaagaaaaggtgcaacaagccaactactttggttctctaactcaagcatcaacaatcagagttgggtcctacaatggagaggagatctatgcccctttcaagagcctcctccctatggtgaacccagatgacatagtgtttgggggatgggacataagcagcatgaacttggctgattccatggctagagccaaggttttggacattgatttacaaaaacagttaaggccttacatggaatccatggtcccactccctggtatctttgaccccgacttcatcgctgcgaaccaaggcgaacgtgccgacaacgtgatcaagggaaccaaaaatgaacaaatccaaaagatcattaaggacatcagggagtttaaggagactaacaaggtagacaaagtggtggtactgtggactgccaacacagaaagatacagcaatgtgatggttgggcttaatgacacaatggaaagcctgtttgcttcattggacaaaaatgaggctgagatttcaccatccactttgtatgctattgcttgcattcttgaaaatgtacctttcatcaatggtagcccacaaaacacttttgtaccaggggttattgatttggctatcaagagaaacagcttgattggtggtgatgactttaagagtggtcaaaccaagatgaagtctgttcttgttgacttccttgttggagctggcataaagccaacatccattgtgagctacaatcacttgggaaacaacgacggaatgaacctatccgctccacagacattcagatccaaggagatatcaaagagcaatgttgttgacgacatggtttcaagcaatgccatcttatacgagcccggggagcatcccgaccatgtggtcgttatcaagtatgttccatatgtcggagatagcaagagagcaatggacgagtacacgtctgagatatttatgggaggtaaaagcacaatcgtcctacacaacacatgtgaggactctctgttggccgctccaatcatcttggacttggtcctccttgctgagctcagtacccgcatccaactgaaagctgaaaccgagggtaagttccattcgttccatccggtggctacgattttgagttaccttacaaaggcccctctggtaccgccgggtacaccagtggtgaacgccctagcgaagcagagggcgatgctggagaacataatgagggcttgtgttggattggcaccagagaacaacatgatcttggagtacaagtgatcggggcatggcttcgttatttattaatacgttttgctttttcaaatgtaacgtgtgtgttgtgctgtcctttgttatatcaagtatttatttggtgacg

SEQ ID NO: 477 - DNA, 1890 bp, Prunus
gcagtacaagcctaggattgagaactgataagtagtgctacaccttaatctttatcttctctccggtctttgtttggttccatagaaaatctaattttctcggggaggaagaacaaaaacagagattgagaaaatgttcatcgagagctttaaggtagagtcccctaatgtaaagtacacggagaatgagattcattccgtgtacagctacgagaccactgagcttgtccatgaggaaaggaagggcacataccaatggattgtcaagcccaagactgtcaaatatgaattcaagactgatatccatgtccccaaactaggggtaatgcttgtgggctggggtggaaacaatggctcaactcttactgctggtgtcatagcaaacagagaaggaatctcctgggcaaccaaggacaaggtgcaacaagccaattactttggctcactgacccaagcctcatcaatccgtgttgggtctttcaatggagaagaaatctatgccccatttaagagcctgcttcctatggttaacccagatgacattgtgtttgggggttgggatataagtgatatgaacctagcagatgctatggctagggccagggtcctggacattgatctgcaaaagcaactgaggccatacatggagtccatgctcccactccctggaatatatgaccctgatttcattgctgctaaccaaggtgcacgtgccaacaacgtgatcaaggggaccaagaaggaacaagtccaacaaatcatcgaagacattagagagtttaaggagcagaacaaagtggacaaggtggttgtgctgtggactgccaacactgagaggtacagtaatgtggttgtggggttaaacgacaccgtggagaaccttttgggttcagtggacaagaatgaagctgagatttctccttccaccttgtatgccatagcttgtgttcttgaaaacgttcctttcatcaatgggagcccgcaaaacacttttgtcccagggctaattgatttggcaataaggagaaactgtttgattggtggggatgattttaagagtggtcagaccaagatgaaatcagttttggttgatttccttgttggggctggcatcaagccaacatccatagtgagctataaccatcttggaaacaatgatggcatgaatctttcagccccacaaaccttcaggtccaaagagatttcaaagagcaatgttgtggatgacatggtctctagcaatggcatcctctatgagcctggtgaacaccctgaccatgttgtggtcatcaagtatgtgccatatgtggcagatagcaagagagccatggatgagtacacttctgagattttcttgggtgggaaaaacaccattgtgatgcacaacacctgtgaagactccctcttggctgctcctatcatccttgatttggttctccttgctgagctcagcactcgcatacagctcaaatctgaagcagagggcaagttccactctttccacccagtggcaaccattctcagttacctcagcaaggctcctcttgttccgccaggcactcctgtggtgaatgcactgtcaaagcagagggcaatgctggagaatatcctgagggcttgtgttggtctggctcctgagaacaacatgattttggaatacaagtgaaccaaagagatggaagatttgattcagaaagttcaagaatcactcccttcctgtttatttaatctggtgtttgcagattgtgtgagtagtctttgtgtttgatcttttacttttctatttctaggtgatcccaaagtatgtaatgcagttgcttctagctcattcagaagcaagcaattgtaatggaattagaaatttataatattggacggtagttatgtgcc

SEQ ID NO: 478 - DNA, 1728 bp, Phlya
aaagagagaacatttaggagaaagagagacatttgtgcctcgatcctaaagtcttggaggagtttgcatctctctctcctcttttacttaaataaaaattgtttcttttgagatcccagaaagaaaaaagagacgaaaaaatgtttattgagagcttcaaagttgacagcccaaatgttaagtacaccgagggtgagattcactctgtgtacaactatgagaccacggagctccttcatgagaacagaaatggggcttatcagtggactgtcaagccaaagactgttaaatatgagtttaaaaccgacacccatgtcccgaaactaggggttatgcttgttggatggggaggtaacaatggttcgactcttactgctggagtcatcgccaatcgggaagggatttcatgggcaacaaaagacaaagttcagcaagccaattattttggatcactcactcaagcgtcctccattagagttggctccttcaatggagaagagatctatgctcctttcaagagcttgctgccaatggtcaacccggacgagatagtcttcggaggatgggacatcagcaacatgaatttggctgatgccatgggaagggccaaggttttggacattgatcttcaaaagcagttgaggccctacatggaacacatggtcccactccctggaatctacgatcctgatttcatcgcagccaatcagggcgcacgtgccaacaacgtgatcaaagggaccaagaaagaacaagtcgaacaactcatcgaagacatcagggagtttaaggagcaaaataaggtggacagtgtagtggtgctgtggaccgccaacacagagagatacagcaacgttgttgttggtctaaacgacacaacagaaaaccttatggcctcactggagaggaatgaagctgagatatctccctcaaccttgtttggcttagcttgtgttcttgaaaatgtgccatttatcaatggcagccctcaaaacactttcgttccagggttgattgaattagcaatccagaggaactgtttgattggaggggatgatttcaagagtggtcaaactaagatgaaatccgttttggttcgattttcttgttggagctggtattaagccgacatcaattgtgagctacaaccatttgggaaacaatgatggaatgaacctatcggccccacaaactttccgatcaaaggagatctcgaagagcaacgtggttgatgatatggttgccagcaatggcatcctctacgagccaggcgagcaccccgatcatgttgttgttatcaagtatgtgccgtatgtgggagacagcaagagggcaatggacgagtacacatccgagatattcatgggagggaaaagcaccattgtgctgcacaacacttgcgaggactctcttcttgctgctccaattatcttggatttggtcctccttgctgagctcagcacccgtattcagctcaaggccgaaggagagggcaaattccactcgttccacccggtcgccaccatcctgagctacctaaccaaggcccctcttgtgcctcccggcacaccggttgtgaacgcgctctcgaagcaacgggcgatgctcgagaacattttgagggcttgtgttggattggctccggaaaacaacatgatcctggagtacaagtgaagaatgggtgctacttaagggagaattggttcaagatatgagcatgcaaatcta

SEQ ID NO: 479 - DNA, 1851 bp, Pteridium
ggaggcagtttctctagtttgggtttcattgttgttctcggttgtgtttttttagccttaagaaaagcatcggcaaaatgttattgagagctttaaggtagagagcccaaatgtgaagtacacagacaatgagattctgtcggtgtacaactatgagaccaccgagcttgttcatgagaacaggaatggaacctatcaatgggttgtaaaacctaagaccgtcaaatatgaattcaagactgatacccatgtccctaaactaggggtgatgcttgtgggatggggaggaaacaatggttcgactctgactggtgctgttatagccaaccgagagggaatctcctgggccactaaggacaaggtgcaacaagccaattactttggttctcttactcaagcatcaacaatcagagttggatcttacaatggagaggagatttatgccccatttaagagccttctccccatggtgaacccagaggatattgtgtttggagggtgggacataagtgacatgaacctagctgatgcaatggctagggccaaggtttttgatattgatttgcagaagcagctgaggccctacatggaatccacggtcccaatccctggaatctacgacccggatttcattgctgccaaccaaggtgaacgtgccaacaacatcatcaaggggaccaagaaagaacaagttcagcaaatcatcaaagatattagggagttcaaggagaaaaacaaggtggacagggtggttgtactctggactgcgaacactgagaggtacagcaatgtaattgtaggtctaaacgacaccatggagagcctcttgggttctctggagaagaatgaatcagaaatatctccttccactttgtacgccatcgctagtgttcttgaaaatgttcccttcatcaatggaagcccacaaaacacctttgttccagggttaattgatttggctattcagaggaactgcctgattggaggagatgactttaagagtggccagaccaagatgaaatctgttctggtggatttccttgttggggctggcatcaagccaacatcaatagtgagctacaaccatcttggaaacaatgatggcatgaatctatcagctccccaaaccttccgctccaaggaaatctccaagagcaacgttgttgatgacatggtctcgagcaatggtatcctctatgagcctggtgaacatcctgaccatgttgtggtcatcaagtatgtgccatatgtgggagatagcaagagagccatggatgagtacacatcagagatattcatgggaggccagaacaccattgtgttgcacaacacatgcgaggactccctgttggctgctcccatcatcctggatttggttcttcttgctgagctcagcaccaggatccagctcaaagctgaaggagagggcaagttccactctttccaccctgtggctactatcctcagttacctcaccaaggcccctcttgttccaccagggacaccagtggtgaatgcactgtcaaagcagcgtgcaatgctggagaatatactgagggcctgcattggcttggctcctgaaaacaacatgatcttggaatacaagtgaagttgaggagagaaaagtggaagaacaagctttggttcttagaactttaggaccattttccctttctctttcataaaagctgtggttcacgttgtcacagattctgatggttgtgtgatgatttgtggtcggtatattatgttttttctctcttttcggatggcgctcacgtgtagctcccttgatgtagctcaatcctgagcaagcacctcttttgtggaaatagatatgataatatgaaa

SEQ ID NO: 480 - DNA, 1775 bp, Ambrosia
ccttacgcccttcggtgtcgtcctcggagagtctcgagacgaggcgcgacgtatacacgacagtagtaccgtcgggaccttcctcctacacacagagaactattatattgttaattaataataaattatctctctcttattctctcttttattcaacatgtttattgagagctttaaggttgagagccctaatgtgaaatacgcagaggatgaaatacactctctgtacaattacgacaccacggagcttgttcatgaagagaaaaacgggtcttatcaatgggttgttaagcccaaaaccgttaaatacgagtttaagacccaaacccatgttcctaaactaggggttatgcttgttggatggggaggcaacaatggctccaccctgaccgcgggtgttatcgctaatcgggagggaatctcttgggcaactaaagagaaggtgcaacaagccaactactttggttctctaactcaagcatcaaccattagagttgggtcatacaatggagaggagatctatgcccctttcaagagcctcctccctatggtgaaccctgatgacatagtgtttgggggatgggacataagcagtatgaacttggctgattccatggccagagccaaggtgttggacattgacctacaaaaacagttgaggccttacatggaatccatggtcccactccctggtatcttcgaccccgacttcatcgctgcgaaccaaggcgagcgtgccgataatgtgatcaagggaaccaaaaatgaacaaatccaaaaggtcatcaaggacattagggagtttaaggaggctaacaaggtagacaaagtggtggttctatggaccgccaatacagaaagatacagcaatgtcatggttgggcttaatgacacaatggaaagtctttttgcatcgttggacagaaacgagtctgagatttcgccatcgaccttgtttgctattgcttgtattcttgagaatgtgccttttatcaatggcagcccacaaaacacttttgtaccaggggttattgatttggctatcaagagaaacagcttgattggtggtgatgactttaagagtggtcaaaccaagatgaagtctgttcttgttgacttccttgttggagctggcataaagccaacatccattgtgagctacaatcacttgggaaacaatgacggaatgaacctttccgctccacagacattcagatccaaggagatctccaagagtaatgttgttgatgacatggtttcgagcaatgccatcttatacgagcccggggagcatcccgaccatgtggtcgtcatcaagtatgttccatatgttggagattccaagagagcaatggacgagtacacgtccgagatattcatgggcggtaaaagcacaatcgtcctacacaacacatgtgaggactctctgttggccgctccaatcatcttggacttggtcctacttgctgagctcagtacccgtatccaactcaaagctgaaaccgagggtaagttccattcattccatccggtggccacgattctgagttaccttacaaaggcccctctggtaccgccggggacaccagtggtgaatgcactagcgaagcaaagggcgatgctggagaacataatgcgggcatgtgttggattggcaccagaaaacaacatgatcttggagtacaagtgatgagggcatggcttatttattttataaatacgttatttgctttttttttcaaatgtaacgtgtgtgatgtgatgtgctatgcttt

SEQ ID NO: 481 - DNA, 2089 bp, Aristolochia
aagcagtggtaacaacgcatccgggggtacagctgaggcatattggcgacgaggaggaaggaagaagctcacatctcttcgttctccctctctctctctctctctctctctctctctctctctctctctctctctctctgagtgccattttgtctagggtttttggattcggttgctgcaatccgctttcccgattcgatttttcattcttcctccgaaaatgtttatcgaaaatttccgtgtggagagcccaaatgtgaagtacatcgacggcgagattcagtccgtttacaattacgagactaccgagctcgttcatgagaaccgtaacggggtttatcagtggatcgtcaagcccaagactgtccaatacgagttcaagaccgacactcgtgtccccaaactcggggtgatgcttgttggctggggcgggaacaatggttcgaccctgaccgctggtgtgatcgccaatcgggagggcatttcatgggcaacaaaagacaaggtacagcaggccaactactttggatctttgacccaagcttcgtccatcagggtcgggtcctttaatggcgaagagatttacgctccttttaagagcttgcttccaatggttaatcctgacgatgttgtcttcggaggatgggacatcagcaacatgaatctggctgacgccatggccagggcgaaggtcctggacttcgatttgcagaagcaggtcaggccctacatggaatccatggttcccttgcctgggatttatgacccggatttcatcgccgccaaccagggctcccgtgccaataacgtaatcaaaggaaccaagaaggaacaagttgaacaaatcatcaaagacattagggaattcaaagaagccaacaaggttgataaagtcgtgatcctctggactgccaacactgagagatacagcaacgtggtggtgggtctcaacgacaccacggagaacctccttgccgccttggacagaaacgaatcggaaatatctccttcgaccctgtatgccttggcttgtgttatggaaaatgttccattcattaatggaagccctcagaacacctttgttccaggcctgattgatttggccattacgaggaacagcttgatcggtggagatgattttaagagtgggcagaccaagatgaagtccgtcttggtggatttcctagttggcgctgggatcaagcccacttcaattgtcagctacaatcacctgggtaacaacgacggcatgaacttgtcagctcctcagaccttcaggtccaaagagatctcaaagagcaacgtcgtcgacgacatggtgtccagcaatggcatcctctacgcccccggcgagcaccctgatcacgtcatcgtcatcaagtatgtgccatacgtgggagacagcaagagggccatggacgagtacacctcagagatcttcatgggtgggaagagcaccatcgtcctccacaacacctgcgaggactcgctcttggccgctccaatcatcctcgacctggtcttgctcgcggagctgagcaccagggttcaactcaaagccgagggagaggctaaattccactccttccacccggtggccaccattttgagctacctcaccaaggcccctctcgtcccgccgggtactccagtggtgaatgccctgtcaaagcagagggcgatgctggagaacataatgagggcctgcattggactggcgccggagaacaacatgattttggagtacaagtgaagaagagtggtggtgagagcagaagggggaggatgaggaggattagagtggatattcccccctcccccgctctctatctctctctctcgactcccgtcgtccccactggtccaagggtgacgtattgttaaaaaatgtgctttggttgtttgtccttaaggctttgatagcttttcgaacttgtttcttttctgttaccgtttctacatgtgtaagtctcttttaagccggtgatgagatgagtctgcagtaccttgttttgtaattacccttatggcaaatatttggatatatataatatatatatcaagtattgattgtagctttaatgttata

SEQ ID NO: 482 - DNA, 1800 bp, Senecio
ctctctccctcctcttatttcatttcattcagattcattgtttaaatccccaaattcaattttaagcaaatatgtttatcgaaagttttaaggttgaaagccctaacgtcaaatataccgacaccgaaatacactctctttataattatgatactactgaattggttcatgaggagaataataatggggcctttcagtgggttgtcaaacctaagactgtcaaatatgagtttaaaactcagactcatgttcctaaattaggggttatgcttgttggatggggagggaacaatggatcaaccttgaccgccggtgtcatcgccaatcgggagggaatatcttgggcaacaaaagaaaaggtgcaacaagctaattactttggttctttgactcaagcatcgactatcagagttggttcctttaatggagaggagattcatgccccatttaagagcctcctccctatggtgaacccagacgacatcgtttttggaggatgggacataagcaaaatgaacttagctgattctatggcaagggcccaggttttggacatcgatctccagaagcagttaaggccttacatggaatccatggtaccgctccctggtatctatgatgctgacttcattgctgctaaccaagggtcacgtgcagataacgtgatcaagggaaccaagaatgagcaaatccaaaagctcattaaggacatcagggagtttaaggagtcaaacaaggttgacaaggtggttgtactctggaccgctaacacagaacgatacagcaatgttgttgtcggccttaatgacacaatggaaagcctgtttgcgtcgttagatagaaatgaatccgagatttctccatctaccttgtttgctattgcttgtattcttgaaaacgtgcctttcatcaatggcagcccacaaaacactttcgtaccaggagtcattgaattagccattaaaaggaactcgttgattggtggagatgactttaagagtggtcaaaccaagatgaagtctgttcttgttgatttccttgttggagctggtattaagccaacatccattgtgagctacaatcacttaggaaacaatgacggaatgaacctttctgctccacaaacattcagatccaaggaaatctccaagagcaatgttgtagacgacatggtttcaagcaatgccatcttatatgagcctggggagcatcccgaccatgtggttgtcatcaagtatgttccatatgtcggagatagtaagagagctatggacgagtacacatctgagatattcatgggtggtaaaagcacaatcgttatgcacaatacatgtgaggactcgctcttggctgctccaatcatcctggatttggtcctacttgctgaactcagtactcgtattgaactcaaatctgaaaccgagggtaagtttcattcgttccatccagttgcaaccatcctgagttaccttacaaaggcccctcttgtaccaccagggacccctgtggtgaacgcactagcgaaacagagggcaatgttagagaacattatgagggcttgtgttggattggcacccgaaaacaacatgatcttggaatacaagtgaaaagtgaggatcatggcatgcccatatgaatttgctttctacttcttaacatgtagtgtttttatttgtcgttcgtctgaaacgtcccatcttttgtaaccaccaagtgtaatgtgtgtcctttgctttgcttttgcttagctttataagtaagtacctttttatttggatacaaatatattctcaaaaaaaa

SEQ ID NO: 483 - DNA, 1878 bp, Tripterygium
aggataagcttagtcttcttgtttggctcagtttcctgcgaaattcaagtggctttcgcctctctttttctctctatctctgtatcttttctcagcgaaaatgtttattgagaattttaaagttgagagtcctaatgtgaagtacacagggacagagattcattctgtgtacaactatgagaccacagagcttcttcatgagaacaggaatggttcatatcaatggactgttaaacccaaaactgtccaatacgaattcaagaccgacacaagtgtccctaaattaggggttatgcttgtgggatggggaggaaacaacggttcagcccttaccggtggtgttatagcaaaccgagaaggaatctcttgggcaaccaaggacaaggtgcagcaagccaactactttggctcactaacccaggcatcatcaattcgagttgggtcttacaatggagaagagatttatgctccattcaagagccttcttcctatggtgaacccagatgagatagtgtttgggggttgggatataagtgacatgaatctggctgatgccatggccagggctaaggtttttgatattgatttgcaaaagcaactaaggccctacatggaacatatggtcccactccctggaatctatgaccctgatttcattgctgccaatcaagactcgcgtgccaacaacgttatcaaaggcactaagaaagaacaagttcaacaagtcatcaaagacattagggaattcaaggaaaaaaccaaagtggacaaggtagttgtgctgtggactgccaacacagaaagatacagtaatgtaattgtgggcttaaatgatactattgagaatctgtttgcttctttggaaaaagatgaagctgagatctccccttccaccttgtatgctttggcatgtattcttgagaacattcctttcgtcaatggaagcccacagaacacttttgtgccaggactaattgatttggccataaagaataacagtttgattggtggagatgactttaagagtggtcagaccaagatgaaatctgtgctggttgatttccttgttggggctggcatcaagccaacatcaattgtgagctacaaccacttgggaaacaatgatggcatgaatctctcagcaccccaaaccttccgctcaaaagaaatctccaaaagtaatgttgttgatgacatggttgcaagcaatggcatcctcttcgagcccggtgaacatcctgaccatgttgttgtcattaagtatgtgccgtatgttggagacagcaagagggctatggatgagtacacatccgagatattcatgggtggtagaaacacaattgtgctgcataacacatgcgaggactcgctcctggctgcacccatcatcttggatttggttctccttgctgaactcagcaccaggatccagatcaaagctgaagatgaggggaagttccattccttccaccctgtggctaccattctcagttacctcaccaaggcccctcttgttccaccaggcactccagtggtgaatgcactgtcaaagcagcgtgcaatgcttgagaacatactgagggcgtgtgttggtctggctcctgagaacaacatgattttggaatacaagtgaaattattatagaatgagggagaaagaagagcgactgcaagcaattctttgattatgtattcccttcttctgtagacctgtggtgaatagttttatatagttatcatagatgcaatgctgggtggtgttgagtggtcatagtgtttctatctatctttttgaatggtgctcataattatgaatatatatggagcaagcatctttttgtgatgaaaattataaataataaaaacaaaattgtgtttc

SEQ ID NO: 484 - DNA, 1840 bp, Artemisia
agtggtaacaacgcagtactccaacggggacctcatcacacacacataaataactttctgtctctcctcttgatctcttccttttacatagtcgttttaagattaccttttacgaatatgtttatcgagagctttaaggtagaaagccctaacgttaagtacagtgaggatgaaatacactcagtgtacgattacgatacaaccgaactcgttcatgaggagaaaaacggtgcttatcaatgggttgttaggcccaaaaccgttaaatacgagttcaagactcaaaccaatgttcctaaattaggggttatgcttgttggatggggaggcaacaatggatcaaccctaactgctggtgtcatcgcaaatcgcgagggaatatcttgggcaaccaaagataaagtgcaacaagccaattactttggttcgttgactcaagcgtcaactatcagagttgggtccttcaatggtgaagagatctatgctcccttcaagagccttctgccaatggtgaacccggatgatatcgtgtttggtggatgggacataagcagcatgaacttggctgatgccatggctagagccagggttttggatattgatctccagaagcagttaaggccttacatggaatcaatggttccacttcctggtatctttgaccctgacttcattgctgctaaccaaggttcacgtgccgacaacgtgatcaaggggactaagaacgaacagatccaaaaaatcatcaaggacatcagggagtttaaggaagcaaacaaggtagacaaggtggttgtcttatggactgcaaacaccgaaagatacagcaatgttgttgtcgggcttaatgacacaatggaaaacatgttcgcatcactagacagaaatgaagcagagatttcaccgtcaaccttgtatgctattgcttgtattcttgaaaatgtgccttttatcaatggcagcccacaaaacactttcgtaccaggggttattgaattggcgattaagcataacaccttgattggtggagatgattttaagagtggtcaaaccaagatgaagtctgttcttgttgatttccttgttggagctggtatcaagccaacatcaattgtgagctacaatcacttgggaaacaatgacggaatgaatctctcagctccacaaacattccgatccaaggagatctccaagagcaacgttgttgacgatatggtttctagcaacgccatcttatacgagcctggcgagcatcctgaccatgtggttgtcattaagtatgttccatatgttgctgatagcaagagagcaatggatgagtacacctctgagatattcatgggtggtacaaacaccattgtaatgcacaacacatgtgaagactcacttttggctgccccaatcatcttggacttggtcctacttgctgagctcagtactcgcatcgaactaaaatctgaagcagagggcaagttccattcattccatccagtggctaccatcttaagttaccttacaaaggcccctcttgtaccaccaggtacaccagtggtgaatgcactagcaaaacaaagggcaatgttggaaaacataatgagggcttgtgttggtttggctccagaaaacaacatgatcttggaatacaagtgaagatatgaagtttccatatgaatatgatttgtatttttcaggatgtaatgttttctgttgtttgtttgcaacttcaaacatcttttgtaatcacaagtgtagtgtgtgtgctttgctttgcttttgcttagcttagcctagcttttaagaagttactacctttttatttgaagatgaatgaatatatttg

SEQ ID NO: 485 - DNA, 1943 bp, Potato
tgaacacttgttcttcttctaaattgaataatttctctgatttctctgcttttctttttgtcaaaatgtttattgaaaattttaaggtggaaagcccaaatgtgaagtatatagagaatgaaattcactctgtgtatgattatgaaaccacagagcttgttcatgaagagagaaatggaacttatcaatggattgttaagcctaaatctgtcaaatatgaattcaaaactgatactcatgtgccaaaattaggggttatgcttgttggatggggaggaaacaatggttcaacattgactggaggtgttattgcgaatcgagaaggaatttcatgggcaacgaaagaaaaagtgcagcaagcaaattattttgggtctcttactcaggcatcaacaattcgagttgggtcttacaatggcgaggagatctatgcacccttcaagagcctccttcccatggtcaacccagacgacgtagtatttggaggatgggacattagcaacatgaatttggcagatgccatggtcagggctaaggttttcgaagttgatctgcaaaagcagctgaggccctacatggaatccatggttcctcttcctggtatctatgaccctgacttcattgctgctaaccaagaagcacgtgccaacaacgtgatcaaaggaaccaagaaagaacaagttgatcaaattgttaaagatattagggagttcaaggagaagaacaaggtagacaagatagtggttctatggactgccaacaccgaaaggtacagcaatgtggttgttggccttaacgataccatggaaaaccttttagctgctgtggatagaaatgaggctgaaatatctccttctacattgcatgctattgcttgtattctggaaaatgtgcctttcatcaacggaagccctcaaaacacttttgttccaggtcttattgatttggccataaagagaaacactttaattggtggtgatgactttaagagtggtcaaaccaagatgaagtccgtgttggttgatttccttgttggagctggtattaagccaacgtcaatagtgagctacaatcacttgggtaacaatgacggaatgaatctttctgctcctcaaaccttccggtctaaggagatctcaaaaagtaatgttgttgatgacatggttgctagcaactccattctctatgaatctggcgagcaccctgaccatgtcgttgtgatcaagtatgttccatatgttggagacagcaagagggcaatggatgagtacatgtcagagattttcatgggcggaaagagcaccatagttatgcacaacacttgtgaggactctcttttggcagctccaattatcttggacttggtccttctcgctgaactcagcactcgcattcagctcaaagctgaaggggaggggaagttccactccttccaccctgtgtctactattctcagctacctcaccaaggctcccctggtaccaccaggtactccagtggtgaatgccctttcaaaacagagggcaatgcttgagaacataatgagagcttgtgttggtttggcaccagagaacaacatgattttggaatacaaatgaaaatatatgcagatgaaagaaattactagaagagaatggactcaactcaagtgtagttgcatttgtagaaaagatccattctctatttatttatttttcccttttatatcttatattttctgttttctattttctcatcatcatataattaagtaaagtgtggcatgattgtgaagtgtaggagagcttaaaagggccaaaatcttgtttattgtaacttcttctctttcatgtttttggccttcttgtctccaaattgtattgttggttgctttagctcagaaagccagcaacatcttgtttctattgaaaaaaaaataatacaacatggtgatttaaattttg

SEQ ID NO: 486 - DNA, 1871 bp, Rose
ggagcagcacaatcctaaggattgagattgagaggtaggagtagcatttccagagagagagagagtttcattttccggcgaaaaacaaagcaataaaaaaatgttcattgagagttttaaggtagagtcccctaacgtagagtacactgagaatgagattcattccgtgtacacctacgagaccactgagcttgtccatgagaataggaagggcacttaccagtggattgttaagcccaagtctgtcaaatacgaattcaagactgatgtccatgtccccaaactaggggtaatgcttgtgggctggggtggaaacaatggctcaaccctcactgctggtgtcattgctaacagagaaggaatctcttgggcaactaaggacaaggtgcaacaagccaattacttcggctcactcacgcaagcctcatcaattcgtgttgggtctttcaatggggaagagatctatgctccattcaagagccttcttcccatggtgaaccctgatgacattgtgtttgggggttgggacattagtgatatgaacttggcagatgctatggccagggccagagtcctggacattgatctgcaaaagcagctcaggccttacatggagtcgatggtcccactccctggaatctatgaccctgatttcattgctgctaatcaaggttcgcgtgcaaacaacgtgatcaaagggactaagcaggaacaagtccaacagatcatcaaagacattagagagttcaaggagaagaacaaagtggacaaggtggtcgtgctgtggactgccaacactgaaaggtacagtaatgtgatggaggggctaaacgacaccgtcgagaaccttttgggttcggtggacaagaatgaagctgagatatccccttccaccttgtatgccatagcttgtgtgatggaaaatgtccctttcatcaatggaagcccacaaaacacttttgtcccagggctcattgatttggccatcaggaggaacactttgattggtggggatgactttaagagtggtcagaccaaaatgaaatctgttctggttgatttcctagtgggagctggtatcaagccaacatcaattgtgagctacaaccatcttggaaacaatgatggtatgaacctttcagctccacaaaccttcagatccaaggaaatttccaaaagcaatgttgtggatgatatggtgtcgagcaatggcatcctctttgagcctggtgagcaccctgatcacgttgtggtgatcaagtatgtgccctatgtggcggatagcaagagagctatggatgagtacacatctgagatattcttgggtgggaggaacaccattgtgatgcacaacacctgtgaggactccctcttggctgctcctatcattctggatttggttctccttgctgagctgagcactcgtatccagctcaaatctgaagatgagggaaagttccactctttccaccctgtggctactattctgagttacctcaccaaggcacctcttgttccaccaggtacaccagtggtgaatgcactttcaaagcagagggcaatgcttgagaacatactgagggcttgtgttggcttggctccagagaacaacatgatcttggagtacaaatgaaacaacctgctagctagagatattcgaaaaattgagtgattcggaatgttcaagaattaatctcgctctctttcgctttctcttttatttagtctgttgttcacagatggtgtgagtagtcttttaattttctatctggagaaaggtacccatggcatgtgtgtagtgcagttgcttctagctcattcagaagcaaagcaactcttttgtaattgaaatatatagataatattggaaa

SEQ ID NO: 487 - DNA, 1964 bp, Solanum phureja
aagcaaaatagattcttgaacacttgttcttcttctaaattgaacaatttctctgatttctctgctttttttttgtcaaaatgtttattgaaaattttaaggtggaaagcccaaatgtgaagtatatagagaatgaaattcactctgtgtatgattatgaaaccacagagcttgttcatgaagagagaaatggaacttatcaatggattgttaagcctaaatctgtcaaatatgaattcaaaactgatactcatgtgccaaaattaggggttatgcttgttggatggggaggaaacaatggttcaacattgactggaggtgttattgcgaatcgagaaggaatttcatgggcaacgaaagaaaaagtgcagcaagcaaattattttgggtctcttactcaggcatcaacaattcgaattgggtcttacaatggcgaggagatctatgcacccttcaagagcctccttcccatggtcaacccagacgacgtagtatttggaggatgggacattagcaacatgaatttggcagatgccatggtcagggctaaggttttcgaagttgatctgcaaaagcagctgaggccctacatggaatccatggttcctcttcctggtatctatgaccctgacttcattgctgctaaccaagaagcacgtgccaacaacgtgatcaaaggaaccaagaaagaacaagttgatcaaattgttaaagatattagggagttcaaggagaagaacaaggtagacaagatagtggttctatggactgccaacaccgaaaggtacagcaatgtggttgttggccttaacgataccatggaaaaccttttagctgctgtggatagaaatgaggctgaaatatctccttctacattgcatgctattgcttgtattctggaaaatgtgcctttcatcaacggaagccctcaaaacacttttgttccaggtcttattgatttggccataaagagaaacactttaattggtggtgatgactttaagagtggtcaaaccaagatgaagtccgtgttggttgatttccttgttggagctggtattaagccaacgtcaatagtgagctacaatcacttgggtaacaatgacggaatgaatctttctgctcctcaaaccttccggtctaaggagatctcaaaaagtaatgttgttgatgacatggttgctagcaactccattctctatgaatctggcgagcaccctgaccatgttgttgtgatcaagtatgttccatatgttggagacagcaagagggcaatggatgagtacatgtcagagattttcatgggcggaaagagcaccatagttatgcacaacacttgtgaggactctcttttggcagctccaattatcttggacttggtccttctcgctgaactcagcactcgcattcagctcaaagctgaaggggaggggaagttccactccttccaccctgtggctactattctcagctacctcaccaaggctcccctggtaccaccaggtactccagtggtgaatgccctttcaaaacagagggcaatgcttgagaacataatgagagcttgtgttggtttggcaccagagaacaacatgattttggaatacaaatgaaaatatatgcagatgaaggaaattactagaagagaatggactcaactcaagtgtagttgcatttgtagaaaagatccattctctatttatttatttttccctttttgtatcttatattttctgttttctattttatcatcatcatataattaagtaaagtgtggcatgattgtgaagtgtaggagagcttaaaagggccaaagtcttgtttattgtaacttcttctctttcatgtttttggccctcttgtctccaaattgtatgttggttgctttagctcagaaagccagcaacatcttgtttctattgaaaaaaaaatacaacatggtgatttaaattttgatttagtaa

SEQ ID NO: 488 - DNA, 1891 bp, Triphysaria
gaaacgatgaaccatttcaaggccaccaatatacaccgccgcgtgtcctctctcatcgcctatatatccaacacctctccgtggcaacttaacaaaatcacacaactcacgctcagtttgggaaaatccaaataatctctctctctctacaaataaccatctcaatatcatcgaagggtttatttttctctctcgtgaacatcaaaaaaaaaaatgtttatcgatagcttcaaggttgacagccccaacgtcaagtacacagagactgagatccattcggtttacaactatgaaaccacggagcttgttcatgagaacagaaatggcacctatcagtggattgtgaagcccaaaactgttaaatacgagttcaaaactgaggctattgtccctaaattgggggttatgcttgtcggatggggaggtaacaatggtacaacccttactgctggtgtgattgcgaatcgagaagggatatcatgggcaacaaaagaaaaagtgcagcaggccaattattttggatcattgactcaggcatcttcgattcgagttgggtccttcaatggtgaagagatttatgctccattcaagagcttgctccctatggtaaacccagatgagatagtatttggaggatgggacatcagcaacatgaatctagcagatgcgatgggacgggccaaggtgttagacattgatctccaaaagcagctgaggccttacatggaacaaatggtcccactccctggcatctacaacccggatttcatcgctgccaatcagggctcacgtgctgacaacctcatcaagggtaccaagaaggaacaagttcagcaactcatcaaagacatcagggagtttaaggagcaaaacaaggtagacaggattgtagttctatggacagccaacacagagagatacagtaatgttgctgttggtctaaacgacacaatggagaatctgatggcctcagtggacagggatgaggctgagatatccccttcgactctattcgccattgcttgcattcttgaaaatgtgcctttcatcaatggcagcccacagaacacttttgttccaggcctgattgagttggccatccagaggaacagtttgattggtggagatgatttcaagagcggtcaaaccaagatgaaatcggtgcttgttgatttcctggttggtgcgggaatcaagccaacttcgattgtgagctacaaccatttggggaacaatgacgggatgaatctgtcggccccacaaacattccgttccaaagagatctcaaagagcaatgtggtggatgacatggttgctagcaatggcatcctctatgaaccgggcgagcaccctgaccatgttgtggttatcaagtatgttccatacgtgggagatagcaagagagctatggacgagtacatgtcggagatattcatgggtggaaagagcactatagtgttgcacaacacatgcgaggactctcttttggctgcacccattattctcgatttggtccttcttgctgagctcagcacccgtattcagctcaaagctgaaggagagggcaaattccattcttttcacccggttgccactatccttagctacctaaccaaggcccctcttgtgccaccggggacccctgttgtcaatgcactgtctaagcaaagggctatgctcgagaacatcttgagggcttgtgttggattggctccagagaacaacatgattttggaatacaagtaaacgaaacagaaataagtattatgtaatccaaattcggttcaaacatatgagggggaatattggaccagtttcctttgttgtttgttcttctggttttactataaatcttgcataaaaataagttttggttttatgtttttatgtg

SEQ ID NO: 489 - DNA, 1902 bp, Apple
cagtgcaaggcttaggtttcagatttcagtatagtgttacaccttcatcttcctatcctctccaatcttgtttggttcccaagaaaattcaatttcctaggaaggaagagaaggaaaaaacagagaagatgttcatcgatagcttcaaggtagagtccccaaacgtagcgtacacagagaatgagattcattcggtgtacaactacgagaccactgagcttgtccatgagaacagaaatggagcgtatcagtggattgtgaagcccaaaactgtcaaatacgaattcaagactgatgtccatgtccccaaactaggggtaatgcttgtggggtggggtggaaacaatggctcaaccctcactgctggtgtgattgcaaacagagaaggaatctcctgggcaaccaaggacaaggtgcagcaagccaattactttggctcactgacccaagcctcatccatccgtgttgggtctttcaatggagaggagatttatgccccattcaaaagcctcctccctatggtgaacccagatgacatagtgtttgggggttgggacattagtgacatgaacttagcagatgcaatggcgagggcaaaggtccttgacattgatctgcaaaagcaactgaggccatacatggagtctatgctcccactccctggaatctacgaccctgatttcatcgctgccaaccaaggtgctcgtgccaacaacgtcatcaagggcaccaagaaggaacaactccaacaagtcattaaagacattagagaattcaaggagaagaacaaggtggacagggtggttgtgctgtggactgccaacactgagaggtatagtaatgttgttgtggggctaaacgacactgtcgagaacctgttgggttcagtggacaagaatgaagctgagatatctccttccacattgtatgccatagcttgtgttcttgaaaatattcctttcatcaatggaagcccacaaaacacttttgtcccagggctgattgatttggcaattaggagaaacagcttgattggtggggatgactttaagagtggtcagaccaaaatgaagtctgtgttggttgatttccttgttggggctggaatcaagccaacagccattgtgagctacaaccatcttggaaacaatgacggcatgaatctttctgcaccgcaaaccttccggtccaaggagatttcaaagagcaatgttgtggatgacatggtgtccagcaatggcatactttacgggccaggtgagcaccctgaccatgttgtggtgatcaagtatgtcccatatgttggggacagcaagagagctttagatgagtacacctctgagattttcatgggtgggcaaaacaccattgtgttgcacaacacctgtgaggattccctcttggctgctcctatcatcctcgatttggttctcctcgctgagctcagcacccgtatccagctcaaatctgaagcagaggccaagttccactcattccaccctgtggctacaattctcagttacctcagcaaggctcctcttgttccgccaggtacacccgtggtgaatgcactgtcaaagcagagggcaatgctggagaacatactgagggcttgtgttggtctggctcctgagaacaacatgatcttggaatacaagtgaagtgaagcaaattaagaagttgaagaaatcaatccaatcccaatccaatcccaatcccaatcccaatcccaatccctctctgtttcctttgtaaacgtaatgtttgcagattgtgtgagtagtcggtttctttgtgttatttgatatgtaatgcagttgcgtcttcctcgttcagaagcaatcaactctttcttgtaatggaagtaaattttttttataatattattggacattagttgtt

SEQ ID NO: 490 - DNA, 1956 bp, Aquilegia
ggtgtggaggagagaaaaagcctagtgtccttaaaactctttttgtttgtgagttggttctttgaggcatttcttcaaacacctttcttgtgaaaaaaataaaaaaaaatgtttattgagagtttcaaagttgagagtcctaatgttaagtacactgatgatgagattcattctgtttacaactatgaaaccactgaacttgttcatgagaacaagaatgggtcttatcaatgggttgttaaacctaaatctgttcaatatgagttcaagactgatactcatgttcctaaactaggtgttatgcttgttggttggggtggaaacaatggttcaacacttactgctggtgtgattgctaatagagaaggtatctcttgggctaccaaggataaagttcaacaagctaattactttggctcacttactcaagcttcaaccatccgagttggatcctttaatggggaggagatttatgctcctttcaagagcctactgcctatggtgaaccctgatgacgtggtgtttggaggttgggacataagtgacttgaacttggcagattccatgaccagagctaaggtcttggacatcgatttgcaaaagcaactgaggccatacatggaatccatggtgccactccctggaatttatgaccctgatttcattgcagcaaatcaagggtctcgtgctaaccatgtgatcaaaggcactaaaaaggaacaaatgcaacaagtcatcaaggatataagggagttcaaggaagctaataaagttgataaggtggttgttctctggactgccaatacagaaagatacagtaatgtcattgttggactgaacgatacagtggagagccttttggcttccttggacaagaatgaatccgagatttctccttctaccttgtatgctttggcatgtatctatgaagatgttccttttattaatggaagcccacagaacacttttgtacctggggtcattgatttggcaattaaaaggaatgttttgattggaggagatgattttaagagtgggcaaaccaagatgaaatctgtcttggtagattttcttgtgggggctggaattaagccaacatcaattgtgagctacaaccatctgggtaacaatgatggcatgaatttgtcagcaccacaaaccttccgatcaaaggaaatttcaaaaagtaatgttgtcgatgacatggtatctagcaatgggatcctttatgagcctggcgagcatcctgatcatgtcatcgtcatcaagtatgtgccgtatgtgggtgatagtaagagagccatggatgagtacacatcagagatattcatgggtggcaagagcaccattgttatgcacaatacttgtgaagactctttgttggctgctcctatcatactagatttggtcttacttgctgaattgagcacccggatccagctcaaagctgcgggagagggcaagttccattctttccacccagttgccacaatcctcagttacctcaccaaggccccacttgttccacctggtactccagtggttaatgcactctcaaagcagaggtcaatgcttgagaacatactgagggcttgtgtaggtttggctccagagaacaacatgattttggaatacaaatgaaaggaaggacccattttaatgcgattacgaaaattcaaaggaaaggtgtgtagggtactgtgtgttatcagccacaagctattgtagtttcacatgttgaaaggaacacacggggctgtcagtggtagtgttagatattctccaactttgtaggttctttgtctttagcctttgtaggtcgagtcgttttcagtgtccttcctctgctttggtccatgcagttgtttgatatgtgaagtgagatccgtatgtcatatatttttagtttgtttggttgtaaacaactatgtattataaacttatatattgcatttg

SEQ ID NO: 491 - DNA, 1822 bp, Arnica
tctatatacacccatcactccccgctgcacaaatcacctctctctctatctccctgcattcaaatttgttgtttgatcagggaatatgtttatcgagagctttaaggtagaaagccctaacgttaagtacaccgaggatgaaatacactctgtgtacaattacgacaccacagagcttgttcacgaggagaaagacggtgcttatcaatggcttgttaagccaaaaaccgtcaaatacgaattcaaaactcaaactcgtcttcccaaactaggggttatgcttgttggatggggaggcaacaatggatcgaccctaactgccggtgttattgcaaatcgggagggaatatcttgggcaaccaaagagaaagtgcaacaggccaactactttggttccttgactcaagcatcaactatcagagttgggtcattcaatggagaggagatctatgcccctttcaagagcctcctcccaatggtgaacccagatgacatagtgtttgggggatgggacataagcagcatgaacctggctgattccatggccagagccaaggttttggacattgatctccaaaagcaactaaggccttacatggaatccatggttccagtccctggtatctttgaccctgactttattgctgcaaaccaaggtgcacgtgcagacaactgcatcaagggtaccaaaaatgaacagatccaaaagatcatcaaggacatcagggagtttaaggaggctaacaaggtagacaaagtggtggttctgtggactgccaacacagaaagatacagcaatgtaatgtttgggcttaatgacacaatggaaagcctgtttgcatcgttagacaaaaacgaagctgagatttcaccatcgaccttgtatgccattgcttgtattctggaaaatgtcccattcatcaatggaagcccacaaaacactttcgtaccaggggttattgatttggctatcaagagaaacaccttgattggtggagatgacttcaagagtggtcaaaccaagatgaagtctgttcttgttgatttccttgttggagctggcataaagccaacatccatcgtgagctacaaccacttgggaaacaatgacggaatgaacctctcggctccacaaacgttcagatccaaggagatctctaagagtaatgttgttgatgacatggtgtcaagcaatgccatcttatatgagcccggggagcatcctgaccatgtggtggtcatcaagtacgtgccatatgtgggagatagcaagagagcaatggacgagtacacatccgagatattcatgggcggtaaaagcacaattgttctacacaatacatgcgaggactcactgttggccgctccaatcatcttggacttggtcctgcttgctgagctcagtactcgcatccaactcaaagctgaaactgagggtaagtttcattcgttccatccggtggctacgattctgagttaccttacaaaggcccctcttgtaccaccagggacaccagtggtgaatgcactagcaaagcagagggcaatgctggagaacatactcagggcttgtgttggattggcaccggaaaacaacatgatcttggaatacaagtgatttcagcactatgaattatgttttatatgtctgtggtttcaaatgaaatgtgcgtgctttagctttaacaagtatgtatttatttggagatgaatgtatcccaaaataaacccaaattttctgctcaacacgcatgcatgctcacttatctgtagtgtcttcttaattatgatttataaggtgattgtgtaatcacatctcttt

SEQ ID NO: 492 - DNA, 1816 bp, Cirsium
cctcctcactctcattccttcccccaaacactcgcactcaaatttgcttcagattcatttgggtctagaaatcctgaccaaatatgtttatcgagagctttaaggtcgaaagccccaatgttaagtacacttccgatgagattcactctctgtacaattacgataccacagagcttgttcacgaggagaaggacggagcttttcaatgggttgttaagcccaaaaccgtcaaatacgagttcaaaactcaaactcctgttcctaaattaggggtgatgcttgtcggatggggaggcaacaatggttcaaccctaactgctggtgttatcgcaaatcgagagggaatatcttgggcaactaaagacaaagtgcaacaagccaactactttggttccttgactcaagcatccactatccgagttggatcgttcaatggagaggagatctatgcccctttcaagagcctcctcccaatggtgaaccctgacgatatcgtatttgggggatgggacataagcagcatgaacttggcagattccatggcaagggccagggttttggacattgatctccaaaagcagttaaggccttacatggaatccatggtcccactccctggtatctttgaccctgacttcattgctgccaaccaaggttcacgtgcagacaacgtgatcaagggaaacaagaacgaacagatccaaaaaatcatcaaggatatcagggagtttaaggaggcaaacaaggtggagaaggtggtggtactgtggacagccaacacagaacgatacagcaatgttgtagttgggctgaatgatacaatggagaacctttttgcatcaatagacaagaatgaagctgagatttctccatcaaccttgtatgctatcgcttgtattctcgaaaatgtgccattcatcaatggcagcccacaaaacacttttgtaccaggggtgattgatttggccatccagaggaacaccttgattggcggagatgactttaagagtggccaaaccaagatgaaatctgttcttgttgatttccttgtgggagctggtattaagccaacatcgatcgtgagctacaatcacttgggaaacaatgacggaatgaacctgtcagctccacaaacatttcgatccaaggagatctccaagagcaacgtggttgatgacatggtttcaagcaatgccatcttatatgagcctggagagcatcctgaccatgtggtggttatcaagtatgtgccgtatgtgggagatagcaagagagcaatggacgagtacacctctgagatattcatgggtggtacaaacacaatcgtcctgcataatacatgtgaggactctctgttggctgcaccaatcatcttggacttggtcctactggctgagctgagtactcgcatccaactgaaagcagaaagtgagggcaagttccattcatttcatccggtggcaaccatcctcagttacctcacaaaggcccctcttgtaccacccgggacaccagtggtgaatgcactagcaaaacagagggcaatgttggagaacatactgagggcatgtgttggattggcaccagaaaacaacatgatcttggaatacaagtaaagtgaagggggtcatatgaatgaatgctttgtatttctgaagatgtgatgatgtttttgtggtgttgtttgcaacttccttccttccttccttcctgccatctttataatcacaagtgtaatgtttgtttatgtgctttcttacctataacaaggaagtaaactaccctttttttttttatagataaataagtagtgtcc

SEQ ID NO: 493 - DNA, 1848 bp, Cleome spinosa
gcagagtacgcggggacgccctcagagatcaaaacaaagctgagaaacaaaaccagctcggttttgcgagatctcgatttctagcgtgagcagagagagagagagagagagaaaatgttcatcgagagcttcaaggtcgagagcccgaacgtgaagtacacggagaatgagattcactccgtgtatgattacgagacgacggagctcgtccatgagaacgttaatggtgcttaccagtggattgtgaagccgaaaactgtcaaatacgaattcaaaaccgatgttcatgtcccaaaattaggggttatgcttgtgggttggggaggaaacaacggttccacccttaccgccggtgtaattgctaaccgagaaggaatttcgtgggctaccaaggacaaagtgcagcaagcgaattacttcggctcactcactcaagcatcgtccattcgtgtcgggtcgtacaatggagaagagatctatgcccctttcaagagccttcttcctatggtgaaccctgacgatgttgtgttcgggggatgggacataagcgacatgaacttggcggacgccatggcaagggccagggttcttgacattgatctgcagaagcagctcagaccttacatggagagcatggttccactccccgggatctacgaccctgatttcatcgctgcaaatcagggctctcgtgccaacagcgtcatcaaaggctccaagaaggaacaagtcgatcagatcatcaaggacatcagggagtttaaggagaagagcaaggttgacaaagttgtggtgctgtggacagcaaacacagagcgttacagcaatgtgatcgctggtctaaacgacacaatggagaacctcttggcttctgtcgacaagaacgagtctgagatctcaccttcaacactttacgccatcgcctgcattttcgaaggtgttcctttcatcaatggaagcccccagaacacatttgtcccaggtcttatcgatatggccatcaggagaaactgcttgattggtggggatgacttcaagagtggtcagaccaagatgaaatccgtcttggtcgatttcctcgttggtgctggtatcaagcctacatcgattgtgagctacaaccatctggggaacaacgatggaatgaacctctcagccccacaaacgttccgctcaaaggagatctcaaagagcaatgtcgtggatgacatggttgccagcaatggcatcctctatgagcccggtgaacaccctgatcacgttgttgtcatcaagtatgtgccgtatgtggcggatagcaagagggcgatggatgagtacacgtcggagatattcatgggagggaagagcacgatcgtgatgcacaacacttgcgaggactctctcttggctgctcccattatattggatcttgttcttcttgctgagctcagcaccaggatccagctcaaagctgaaggagagggaaagttccatactttccacccagtggccaccatcctcagctacctcaccaaggcaccactggtgccgccagggacgccggtggtgaacgcgctgtcgaagcagagggcaatgctggagaatatactgagggcgtgcgttgggcttgcgcccgagaacaacatgatcttggagtacaagtgaaccagaccatgaagaacgctgttcatctgtttctgtttagtataaaactgtctgtggggtttgaagtcgttccctttgtattgtttctgtaatggtggaattgcgtgatgaagagcctgaggtctctcctcttccactttttgtttttgttcttcgagaagcacaggtcataagcttagttaaatttggatcaatgtgtga

SEQ ID NO: 494 - DNA, 2047 bp, Iceplant
ctcttctcatcaaactcattccaagtgccagcggtgagaagaaggagaagaagagaagtagtccaggagagagaaagagagagaaagagagagaaatagttcgagtgagttggcaaccaccctttttttcattttttgaaaaagatccgaaaaaaaggagagagagagagagagaaaatgtttattgagagcttcaaagtagagagcccaaacgtgaagtacacagagaatgagattgaatcggtgtacaactacgacaccaccgagttggttcatgagaatcgcaaagatgctggtggttatcaatggatcgttaagcccaagaccgttcagtatcacttcaagactgacactcgtgtccccaaactcggggtgatgctggttggatggggtggaaataacggctccaccctcacaggtggtgtgatcgccaaccgcgagggaatatcttgggcaaccaaggacaagatccagcaagcgaactattttggttcgttgacccaggcttcttcaattcgggtcgggtcttttaatggagaggagatttatgctcctttcaagagcttgctccctatggtgaacccagatgacgtagtgtttgggggttgggacataagcgacatgaacctggctgatgcaatgaccagggctagggtctttgacattgatcttcaaaagcagctcaggccttacatggagcacatggttcccctccctggtatttacgaccctgatttcatcgctgcgaaccaaggctcccgagccaacaacgtcattaagggcaccaagaaggaacaagttgagcgagtcattaaagacattagggagttcaaggagaagaacaaagtggacaaggtggtggtgctatggactggcaacacagagaggtacagcaatgtggtggtcgggctcaacgacaccatggagaacctgttggcatctctggagaaaaacgagtcggagatttctccatccactttgtatgccttggcatgtatcgaagaaaatattcccttcatcaatggtagccctcagaacacctttgtgccagggctcattgatctggctatcaagaagaacagtttgattggtggtgatgacttcaagagtggtcagaccaagatgaaatctgtcctcgtcgacttcctcgttggggctggtattaagccaacatccatagtgagctacaaccacttggggaacaatgatgggatgaacctgtcagcacctcaaactttcaggtccaaggagatttctaagagcaacgtggtcgatgacatggttgccagcaacggcatcctctatgagccgggcgaacaccctgatcatgttgtggtcatcaagtatgtgccatatgtgggagacagcaagagagccatggatgagtacacttcggaaatatttatggggggaacgaacactattgtcatgcacaacacctgtgaggactctctcttggctgcccccatcatcctggacttggtcctccttgctgaactaagcacccgcattcagctgaaggctgaggaagaggacaagttccactccttccatccggtcgctaccatcctgagttacctcaccaaggcccctcttgttccaccaggcactccagtggtaaatgcactttcgaagcagagggctatgctggagaacatactgagggcttgtgttggtttggctcctgagaacaacatgatcctcgaatacaagtgaggatgaagtcacaagagccacaccacaaggcaacgccctatccgagctgttttatctttgcgtttgctattgttgtggcgttgtactagaaactgatgaaatcaaaaaaaggcagcacccaaaatcaatagcttttgcggtgaatttagtttctcgaacctgtctttgtttatttcgttcttttaagtactggcaattgtggtcgtagatgaaggtgcaggcctctggtgttttgtaatatgtaaattcgctggccttagtgcgattcaagagcaggcagttttttcctgcttagcttaatctaagtgattaatgaagtttctgttgttgc

SEQ ID NO: 495 - DNA, 1907 bp, Pepper
ttcggcacgagggttctttcccttgaatttctctgatttgaatatttgttctgtatggcaaaatgttcattgaaaattttaaagttgaaagtccaaatgtgaaatacacagagaatgaaattcagtctgtgtatatttatgataccacagagcttgttcatgaagcgagaaatggcaattatcaatggattgttaagcctaactctgttcaatatcaatttaaaactgatatccatgttcccaaattaggggtgatgcttgttggatggggaggaaataatggatcaacattgactggaggtgttattgcaaacagagaaggaatttcgtgggcaactaaagaaaaggtgcagcaagcgaattattttgggtctcttactcaggcatcaacaattcgagttgggtcttttaatggtgaagagatctatgcacccttcaagagcctccttcccatggtcaacccagacgacgtagtgtttggaggatgggacattagcaacatgaatttggcagatgccatggtcagggcaaaggttttcgatgttgatctccagaagcagttgaggccctacatggaatcaatggttcctcttcctggtatctatgaccctgacttcattgctgctaaccaagaagcgcgtgccaacaacgtgatcaaaggaaccaagaaagaacaagtggatcaaattattaaagatattagggaattcaaggagaagaacaaggtagacaagatagtggttctatggactgccaacactgaaagatacagcaatgtgattgttggccttaacgacaccatggaaaaccttttagctgctgtggatagaaacgaggctgaaatatctccttctacattgcatgctattgcttgcattcttgaaaatgtgcctttcatcaatggaagccctcaaaacacttttgtcccaggtcttattgatttggctatacagaggaacacattaattggtggtgatgacttcaagagtggtcagaccaagatgaagtctgtgttggttgatttccttgttggagctggtattaagccaacgtcaatagtgagctacaatcacttgggtaacaatgatggaatgaatctttctgcacctcaaactttccggtctaaggagatctcaaaaagcaatgttgtagatgacatggttgctagcaatgccattctctatgaatctggcgagcaccctgaccatgttgttgtgattaagtacgttccatatgttggagacagcaagagggcaatggatgagtacacatcagagattttcatgggtggaaagagcaccatagttatgcataacacttgtgaggactctcttttggcagctcctattatcttggacttggtccttctcgcagaactcagcactcgcattcagctcaaagctgaaggagagggaaagtttcactccttccatcctgtggctacgatactcagctacctcaccaaggctcctctggtaccaccaggtaccccagtggtgaatgccctttcaaagcagagggcaatgcttgagaacataatgagagcttgtgttggtttggcaccagaaaacaacatgattttggaatacaaatgaaaaatatgcagatgaaggaaattactactacaaagagaatggactcatgtgtagttgcatgtgtagacacagaccattctctattttttttttccttttctattttctcatcatcatttaactaagcaaagtgtggcgtgattatgaagtgtaagaagcaaagtgtggcgtgattatgaagtgtaagagcttaaagggccaaagtcctgtttattgttatttttttcctgcatgtttttgggttctcttatctccaaattgtatgttggttgctttagctcagatagagccagcaacatcttgtttgtattg

SEQ ID NO: 496 - DNA, 2003 bp, Platanus
agaatcatttcttcttccctgtttaattagtttctaattgggttctttagttttcgatatcagatattgtgaagatgttcatcgagggtttcaaggttgagagccctaacgttaagtacacagatgatgagatccaatctgtttatagctacgagagtaccgagcttgttcacgagaacaggaatggtacttatcaatggatcgtcaagcctaagacagttcaatacgagttcaagactgatattcgtgttccaaaactaggggttatgctcgttggttggggaggaaacaatggctcaacccttactggtggtattattgcaaatcgggaaggaatctcttgggctaccaaagataaagtacaacaagccaactattttggttcattaacccaggcttcatccatccgagttggttcgttcaatggggaagagatctatgctcctttcaagagcttacttcccatggtgaacccagatgatattgttttggggggttgggacataagcgacatgaacttagctgatgccatggccagggctaaggtctttgatattgatttgcaaaggcagttgaggccttacatggaatccatggtccctcttcccggagtctatgaccctgattttattgcggccaatcaagggtctcgtgctaacaacgttatcaaggggacaaagaaagaacaacttgagcaaatcatgaaggacattagggagttcaaggaggcgaataaggtagacaaggtagtggttctgtggacggccaacacagagagatatagtaatgttgttgttgggttaaatgacaccatggagaacctcttagcttcgttggagaagaacgaagaggagatatctccatcgaccttgtacgctttagcttgtatctatgaaaatgtccctttcatcaatggaagcccacaaaacacctttgtccctggggtgattgatttggctataaagagtaacagtttgattggaggggacgatttcaagagtggccagaccaagatgaaatctgtcttggttgatttcctcgtgggggctggaataaagccaacatctatagtgagttacaaccacctgggcaacaacgacggcatgaatctctcagctcctcaaactttccggtcaaaggagatctccaagagcaatgtggtggatgacatggtgtcaagcaacggcattctctacgagcccggcgagcaccctgaccatgtcatcgttatcaagtacgtgccatacgtgggagacagtaagagggcaatggacgagtatacatccgagatttttatgggtgggaagagcaccattgttcttcacaacacctgcgaggactccttgctggctgctccaattatcttggacttggtcctcctggccgaactcagcactcgaatccaaatcaaagctgaaggagagggcaagttccattccttccaccctgtggctaccatcctcagttatctcaccaaggccccacttgttccaccgggcacgccggtggttaacgccctgtcaaagcagagggcaatgcttgagaacataatgagggcttgtgttggtttggccccggagaataacatgattttggaatacaagtgaagatgatagacttcaagtaaagggaatatgagaagttggtttatgagtaatatgggctcttgttagtctttgtttcctttttcggctttattccacccaccgcagtgataaatgctatcatgcgatggaagaatgaagaagaaaaaggcgtgggtatggtgtttgaagaagatggtctgcagacttgagcagggctttctatcgttttcacatgtaatctgtggtttggctcattttagtgcaagcacttagctgtagtagtaataaaagtcacatgaatatatgtcacaaatatttctaatgctgctttccttacgtctgttctttaatctgttccactttttggttggaaatatctttacgcaatgttgaggaaagaggtgggaagtgaaaact

SEQ ID NO: 497 - DNA, 1748 bp, Valeriana
gatctctctttccagatcgaatttttcgagttttttcaaaatgtttatcgaaagctttaaagtcgattcgccaaatgtcacatacacggagaacgagattcactcggtttacaactacgaaaccaccgaacttcttcacgagaataaaaatggcgcttatcagtggactgttaagcccaaatctgtcaaatacgagttcaaaactgatactcatgttccaaaattaggagttatgcttgttggatggggagggaataatggttctacacttactgctggtgttattgctaaccgagagggaatctcctgggcaactaaagacaaagttcaacaagcaaactattttggctcacttacacaagcctccactattcgggttggttcttttaatggtgaagaaatttatgctcctttcaagagcttgcttcccatggtgaacccagatgatattgtttttgggggatgggacataagtgacatgaacttagccgacgcgatggcgagggctaaagttttggacatagatttgcaaaagcagcttcggtcttacatggaatctatggtcccacttcccggaatctacgatccagatttcatcgcagctaaccaagaatcgcgcgctaacaacgtcatcaaaggaaccaaaaaagaacaagttcaacaagtcatcaaagacattagggagtttaaggaggcaaacaaggtagataaagtagttgttctttggaccgcaaatacagagaggtacagcaacgtgattgtaggcctaaacgataccgaggaaaatttattcgcgtctttggaaaaagacgaagctgaaatttcgccatctactttgtttggaattgcgtgtgttcttgaaaacgttcctttcatcaatggaagcccacaaaatacttttgtgcccgggctcattgatttggctataaggaagaacagtttgattggtggtgatgattttaaaagtgggcagaccaaaatgaaatctgttcttgttgactttcttgttggagctggtattaagccaacttcgattgtgagctacaatcatttggggaataatgacggcatgaatctctcggctccccaaacattccggtcaaaggagatatcgaagagtaacgtcgtggatgatatggtttctagcaatgctatcctttatgaacccggggagcaccccgaccacgtcgttgtcatcaagtacgtgccatatgtgggagatagcaagagggcaatggacgagtatacatcggagatattcatgggcgggaaaagcaccatcgtccttcacaatacttgcgaggattccctcttggctgctcccattatcttggatctcgttctccttgctgagctcagcactcgtattcaactcaaagcccaaggagagggtaaatttcactctttccaccctgtggcggtgattctgagttaccttaccaaagcccctcttgtaccgccaggcacaccggtggtgaatgcgctagcgaaacagagatcgatgcttgagaacataatgagagcttgtgtcggtttggctccggaaaacaacatgattttggaatataaatgaaaaattatgcagttgtgtaaaacaagtttgttctttttggagaattatgtacaatgctcgttttaaattatgtaagaaagattttaattatgtgtttgcacttgcttagaaggttatgttgagatgattatgttgtggattagaaatttagaaaccttaggactaactagtaaaa

SEQ ID NO: 498 - DNA, 1963 bp, B. rapa
caaacccacacaaactcgattcaattcaaaacagagtctgaaaaaatgttcatcgagagcttcaaagtcgagagcccgaacgtgaagtacacggagaatgagattcagtctgtgtacgattacgagaccacggaggtcgttcacgagaacgttaacggtgcttaccagtggatcgtgaagcctaaggttgtcaaatacgatttcaaaaccgacactcgtgtccccaaattaggggttatgcttgtgggttggggaggaaacaatggatcaaccctcaccgccggtgtaattgccaataaagaaggaatctcgtgggcgaccaaggacaaagtgcaacaagctaactacttcgggtcgttaacacaagcatcgtctattcgtgtcggatcctttaacggcgaagagatctatgctcctttcaagagtctcgttccaatggtgaatccggatgatgttgtgtttggaggatgggacataagcgatatgaatttagcagacgcaatgggtagagccaaggttcttgacattgacttacagaaacagctcaggccttacatggagaacattgtcccactccctgggatctacgaccctgatttcatcgctgctaatcaaggctcacgtgccaacaacgtcatcaacggtaccaagaaggaacaagtcgaccaaatcatcaaggacatgagggagtttaaggagaagaacaaggtggataaggttgtggttctgtggacggctaacacagagcgttacagcaatgtggtcgtggggctaaacgacacgatggagaatcttatgaactctgtggatagggatgagtctgagatctctccttccacgctttatgctattgcatgtgttcttgaaggtattcctttcatcaatggaagccctcagaacacctttgttccgggtcttattgatttggctatcaagaacaatgttttgatcggtggagatgacttcaagagtggtcaaaccaagatgaaatctgtcttggttgatttccttgttggtgcaggcatcaagcctacttcaatagtgagctacaatcacctagggaacaacgatggaatgaacctctcagctccacagacattcagatctaaggagatctccaaaagcaatgttgtggatgatatggttgctagcaacggtatcctcttcgagcccggggaacatccagaccatgtagttgtcatcaagtatgtaccgtatgttgcagatagcaagcgagccatggatgagtatacatcagagatattcatgggaggcaagaacacaattgtcatgcacaatacctgcgaggactctctcttagctgctccaattatcttggatcttgttctcctcgctgaactcagcaccaggattcagttcaaatccgagaaagaggggaagtttcattctttccatcctgtggccaccatactcagctacctcaccaaggcaccgctcgtgccgccgggaacaccggtggttaatgcgctgtcgaagcagcgggctatgctggagaacatccttagggcgtgtgttggactggcgccggagaacaacatgatcttggaatacaagtgaacatgaagcgtttaagaatctttaattatcccataatataagacttctatgtttcttgtttttttttctaaatatgttttaagatatgaatgcttgtgttttcagagatcaaagagcttttagattgatctttgtagggtactagggtgtgaagttaccggtgtttctagtaatccagatgggcttagtataatgtacaagtgtttctagattggaccataatttcatatcgcttttatgattcacttccataatgtgtaaactactgtaatttgcgatatttaatcatggtttcggtccaatgaaatttgtcaattttaattctgtattattattttattgtgaacttaagaaaatccgatcaagttgtgtagatgacgagcaa

SEQ ID NO: 499 - DNA, 2312 bp, B. rapa
ccactcgcctgtggaaaaagaaagggaccaccgcgaagactgacgaaccgccacgtgtccctccatctctacgtcttctctatataacctcgcacttgttcctcgattcaagatcacaaaccaaacacacatagagcttaacgcaaagagagagagagagagaaagagagcgaagatgttcatcgagagcttcaaggtagagagcccaaacgtgaagtacacagagaacgagatccattccgtgtacgattacgaaaccaccgaggtcgtccatgagaaccgtaacggcacttaccaatgggtcgtcaagcccaaaaccgtcaaatacgatttcaaaacagacactcgtgtccccaagctaggcgtcatgctcgttggatggggaggaaacaacggatcaaccttaaccgccggtgtgatcgccaacaaagaagggatctcttgggcgactaaagacaaagtgcaacaagcaaactactttggctccctcactcaagcttcttcgatccgggtcggatcttacaacggtgaagagatctacgctcctttcaagagtcttctccccatggtgaaccctgacgatgttgtgtttggtggttgggacataagcgacatgaacttagcagacgccatggctagagccagagttctcgacattgatctccagaaacagctcaggccttacatggagcacatggtcccactccctgggatatacgaccctgacttcatcgctgcgaatcaagggtcacgtgctaatagcgtgataaaaggtactaagaaagaacaagtcgaccagatcatcaaggatatgagggagtttaaggagaagaacaaggtggataagctagttgtcttgtggacagccaacacagagcgttacagcgatgtggtcgtagggcttaacgacacgatggagaatctcttggcttctgtggagaagaacgagtctgagatctcgccttctacgctttatgcgatcgcttgtgttcttgaaggcattccttttatcaatgggagtcctcagaacacgtttgttccaggactcatcgagctggctataacgaagaactgtttgatcggtggggatgatttcaagagtggtcagactaagatgaagtctgttctggtcgatttccttgtcggagctggcatcaagcctacttcgattgtgagctataatcatttgggaaacaatgatggcatgaacctctcggcgccgcagactttcagatccaaggagatctcaaagagtaatgtggtggacgacatggtggctagtaacggcatcctctttgagcctggtgaacatcctgaccatgttgttgtcatcaagtatgtgccttatgttggggatagtaagagagccatggacgagtacacctcggagatattcatgggagggaagaatacaattgttatgcataacacttgtgaggattctctattggctgctccaatcatcttggatcttgttcttctcgctgagctcagcaccagaatccaattcaaagctgaaggagaggggaagtttcactctttccacccagtagctaccatactcagttacctcacaaaggcacctcttgtaccacccgggacacctgtggtgaacgccctatctaagcagagggctatgctggagaacatcctcagggcctgcgttgggcttgcgccagagaacaacatgatcttggagtacaagtgaaggacaatgaagaagaagcagagggacctaagactttagaacatgaagagttattatgcttcattgtttcgtttataaataatttgaattgtgtaagagagagacatatcaagaagctttgtgtgataatatgatctgagctgttatatttgtgagaagattagctataagcttttgaatcaaatgtgtaatagatttaagattttagagaataactatgtgtcgtccctccttgtgttatgatctattaaaatggttttctatatatagtcacaatctgctctatttcaatgcgtctgtgaagattcaataaagaagacaaaagggtaaagagaacaaacatatatagcgagtgagatcaagaactgccagcagaaaccatcatgaactcgccctcgcagaccaaagagccacccacataagctttaccttccatcttagcaagcccgaaccgtttctggaacttgacaagagtcatcctcatcaccaacgtgtctcctgcgatcacaggcttgcggaacctcactttatcaataccagcaaagaagatgttattatcctgagaccctcctcctacttccggctgcagcattactattcctcc

SEQ ID NO: 500 - DNA, 1999 bp, Canola
cttaagagagtcaacgagagagccgactagcttgattggtaaagtaccctaacttagtttgtattcatggcgtgtgtcatgatattatcaatatatgccagcttccttggtaggaatagcgtaaaggtaaagtaacttactggtggagctgctattgcatgcttaagtaaaggataattagaccttccatattgttccagacaaaccaaacacacatagagcttaacgcaagagagagagagagagaaagagagcgaagatgttcatcgagagcttcaaggtagagagcccaaacgtgaagtacacagagaacgagatccattctgtgtacgattacgaaaccaccgaggtcgtccatgagaaccgtaacggtacttaccaatgggtcgtcaagcccaaaaccgtcaaatacgatttcaaaacagacactcgtgtccccaagttaggcgtcatgctcgttggatggggaggaaacaacggatcaaccttaaccgccggtgtgatcgccaacaaagaagggatctcttgggcgactaaagacaaagtgcaacaagcaaactactttggctccctcactcaagcttcttcgattcgggtcggatcttacaatggtgaagagatctacgctcctttcaagagtctcctccccatggtgaaccctgacgatgttgtgtttggtggttgggacataagcgacatgaacttagcagacgccatggctagagccagagttctcgacattgatctccagaaacagctcaggccttacatggagcacatggtcccactccctgggatatacgaccctgacttcatcgctgcgaatcaagggtcacgtgctaatagcgtgatcaaaggtactaagaaagaacaagtcgaccagatcatcaaggacatgagggagtttaaggagaagaacaaggtggataagctagttgtcttgtggacagccaacacagagcgttacagcgatgtggtcgtggggcttaacgacacgatggagaatctattggcttctgttgagaagaacgagtctgagatctcgccttctacgctttatgctatagcttgtgttctcgaaggcattcctttcattaatgggagtccgcagaacacgtttgttcctggactcatcgagctggctataacgaagaactgtttgatcggtggggatgatttcaagagtggtcagactaagatgaagtctgttttggttgatttccttgtcggagctggtattaagcctacttcgattgtgagctataatcatttgggaaacaatgatggcatgaacctctcggcgccgcagactttcagatccaaggagatctcaaagagtaatgtggtggacgacatggtggctagtaacggtatcctctttgagcctggtgaacaccctgaccatgttgttgtcatcaagtatgtgccttatgttggggatagtaagagagccatggacgagtacacctcagagatattcatgggagggaagaatacaattgttatgcataacacttgtgaggattctcttttggctgctccaatcatcttggatcttgttcttctcgctgagctcagcaccagaatccaattcaaagctgaaggagaggggaagtttcactctttccacccagtagctaccatactcagttacctcacaaaggcacctcttgtaccacccgggacacctgtggtgaacgctttatccaagcagagggctatgctggagaacatcctcagggcctgcgttgggcttgcgccagagaacaacatgatcttggagtacaagtgaaggacaatgaagaagaagcagagggacctaagactttagaacatgaagagttattatgcttcattgttttgtttataaaataatttgaattgtgtaagagagacatatcaagaaacttaagtttaatttgtgtgataatatgatctgagcagtttaattagtgagaagattaagctaagcttttggatcaaatgtgtaatagatttg

SEQ ID NO: 501 - DNA, 1910 bp, Canola
accaccaccaccatcatggctacaacggacctcacggtgatggatcgggtcaaaaccagcacccgactccttcgccttcagtatcgtccgtcgctaagtcgcttcaattcaaacacagagtctgaaaaaatgttcatcgagagcttcaaagtcgagagcccgaacgtgaagtacacggagaatgagattcaatcggtgtacgattacgagaccacggaggtcgttcacgagaacgttaacggtgcttatcagtggatcgtgaagcctaaggttgtcaaatacgatttcaaaaccgacactcgtgtccccaaattaggggttatgcttgtgggttggggaggaaacaatggatcaaccctcaccgccggtgtaattgccaataaagaaggaatctcgtgggcgaccaaggacaaagtgcaacaagctaactacttcgggtcgttaacacaagcatcgtctattcgtgtcggatcctttaacggtgaagagatctatgctcctttcaagagtctcgttccaatggtgaatccggatgatgttgtgtttggaggatgggacataagcgatatgaatttagcagacgcaatgggtagagccaaggttcttgacattgacttacagaaacagctcaggccttacatggagaacattgtcccactccctgggatctacgaccctgatttcatcgctgctaatcaaggctcacgtgccaacaacgtcatcaacggtaccaagaaggaacaagtcgaccaaatcatcaaggacatgagggagtttaaggagaagaacaaggtggataaggttgtggttctgtggacggctaacacagagcgttacagcaatgtggtcgtggggctaaacgacacgatggagaatcttatgaactccgtggatagggatgagtccgagatctctccttccacgctttatgctattgcatgtgttcttgaaggtattcctttcatcaatggaagccctcagaacacctttgttccgggtcttattgatttggctatcaagaacaatgttttgatcggtggagatgacttcaagagtggtcaaaccaaaatgaaatccgtcttggttgatttccttgttggtgcaggcatcaagcctacttcaatagtgagctacaatcacctagggaacaacgatggaatgaacctctcagctccacagacattcagatctaaggagatctccaaaagcaatgttgtggatgatatggttgctagcaacggtatcctcttcgagcccggggaacatccagaccatgtagttgtcatcaagtatgtaccgtatgttgcagatagcaagcgagccatggatgagtatacatcagagatattcatgggaggcaagaacacaattgtgatgcacaatacctgcgaggactctctcttagctgctccaattatcttggatcttgttctcctcgctgaactcagcaccaggattcagttcaaatccgagaaagaggggaagtttcattctttccatcctgtggccaccatactcagctacctcaccaaggcaccgctcgtgccgccgggaacaccagtggttaatgcgctgtcgaagcagcgggctatgctggagaacatccttagggcgtgtgttggactggcgccggagaacaacatgatcttggaatacaagtgaacatgaagcgtttaagaatctttaattagcccatattataagacttctatgtttcttgtttttttttctaaatatgttttaagatatgaatgcttgtgttttcagagatcaaagagcttttagattgatctttgtagggtactagggtgtgaagttaccggtgtttctagtaatccagatgggcttagtataatgtacaagtgtttctagattggaccataatttcatataatcgcttttatgattca

SEQ ID NO: 502 - DNA, 2004 bp, Oil palm
acgttctttcaggtactagaaaataataagatttacaaaggtagacacggatcataggcagtcacaaacttagacaacctacaacaaaaattaacaacgaaagggaatacaagcggagagataggaagagagagagaaggctacagctatatatttatatattctttcgttcttcctcactctccctaatctctaattaatctcgattagatttgagatttaggaggattaagagcgaagatgtttatagagaagtttaaggtggagagccccaacgtgaagtatggagagcacgagatcgagtcggtgtatcactacgagaccaccgagctcgtccatgagaaccgtgatgggtcctaccaatggatcgtcaagcctaagaccgtccgattcgatttcaagaccgacacccgagtccccaagctcggggtgatgctggcggggtggggagggaacaatggggccaccctcacggctggggtcattgctaacagagaggggatctcatgggcgaccaaggataaagtgcagcaggctaactattatgggtcactgactcaggcttccaccatcagggttggatctttcaatggggaggagatctatgcgcctttcaagagcttgcttcccatggttaacccagacgacatcatctttggaggttgggatataagtaacatgaacctggctgatgccatggccagggccaaggttttggacatagacctccagaagcagctcaggccctacatggagtccatggtccccctcccggggatctacgaccccgatttcattgctgccaaccagggatcacgagctaataacgtgatcgaggggaccaagaaggagcaggtccaacagatcatcaaggacataagggagtttaaggagaagaacgaggtggataaggtggtggtgctatggacagcaaatacggaaaggtacagcaatgtgattgtggggctcaatgacactatggagaacctcttggcttcgttggacaggaacgaggctgagatatccccatcaaccttgtatgcgctagcttgtgtcctagagaatgtcccgttcatcaatggaagtccccagaatacctttgtgccgggactgattgatctggctattaagaggaacagtcttattggtggagatgacttcaagagtgggcagacaaagatgaagtctgtcttggtggattttcttgtgggagctggaatcaagccaacctctatagttagctacaaccacctgggaaacaatgatggcatgaatctctctgccccacaaactttccggtcgaaagagatttcgaagagcaatgttgttgatgacatggtctctagcaatggcatactctatgggcctggggagcatccagaccatgttattgtcatcaagtatgtgccctatgttggggacagcaagagggctatggatgaatacacatcagagatattcatgggtgggaggaacacaatcgttcttcacaacacatgcgaggactcgctgttggcagcacccatcatcctggatctggttttgctagctgagctcagtactaggattcagctcaaagctgagggagagggaaagttccactccttccatccagtggccagtatcttgagttatctcaccaaagctccccttgtccctccaggaacacctgtggtgaacgcccttgcaaagcagagggccatgctggagaacatcctgagggcttgcattgggctttcccctgagaacaacatgatcctagagtacaagtgaacccaccagagatagaaagaaggtggctaatgggatggagaagaagggtgtcttggcccttttctgttgtatgcttcttgtgtttatatggggtctcttttctttttgacttgtatggttatgtgctttgctttagctgcttcagcttcaaatctagtgggaacccctattataaatggacttcttttggtgatatgttactctttgtgatctgtgattactcttggtgaa

SEQ ID NO: 503 - DNA, 1767 bp, Canola
aaaccaaacacacatagagcttaacgcaaaagagagagagagagagagagcgaagatgttcatcgagagcttcaaggttgagagcccaaacgtgaagtacacagagaacgagatccattctgtgtacgattacgaaaccacggaggtcgtccatgagaaccgtaacggcacttaccaatgggtcgtcaagcccaaaaccgtcaaatacgatttcaaaacagacactcgcgtccccaagctaggcgttatgctcgttggatggggaggaaacaatggatcaaccttaaccgctggagtgatcgccaacaaagaagggatctcgtgggcgactaaagacaaagtgcaacaagcaaactactttggctccctcactcaagcttcttcgatccgggtgggatcttacaatggtgaagagatctacgctcctttcaagagcctcctccccatggtgaaccctgacgatgttgtgtttggtggttgggacataagcgacatgaacttagcagacgctatggctagagcaagagtccttgacattgatctccagaaacagctcaggccgtacatggagcacatggtcccactccctggtatctacgaccctgacttcatcgctgcgaatcaagggtcacgtgctaatagcgtgatcaaaggtaccaagaaagaacaagtcgaccagatcatcaaagacatgagggagtttaaggagaagaacaaggtggataagctggttgttctgtggacagccaacacagagcgttacagcgatgtggtcgtagggcttaacgacacgatggagaatctattggcttctgttgagaagaacgagtctgagatctcgccttctacgctatatgcgattgcttgtgttcttgaaggcattcctttcattaatgggagtccgcagaacacgtttgttcctggactcatcgagctggctatatcgaagaactgtttgatcggtggggatgacttcaagagtggtcagactaagatgaagtctgttttggttgatttccttgtcggagctggcatcaagcctacttcgattgtgagctataatcatttgggaaacaatgacggcatgaacctctcagcgcctcagacttttagatctaaggagatctcaaagagcaatgttgttgacgacatggtggctagtaacggtatcctctttgagcctggtgaacatcctgaccatgttgtcgtcatcaagtatgttccttatgttggggatagtaagagagccatggacgagtacacctcggagatattcatgggagggaagaatacgattgttatgcataacacttgtgaggattctcttttggctgctccaatcatcttggatcttgttcttctcgctgagctcagcaccagaatccaattcaaagctgaaggggaggggaagtttcattctttccacccagtagcaaccatactcagttacctcacaaaggcacctcttgtaccagccgggacacctgtggtgaacgctctatctaagcagagggctatgctggagaacatcctcagggcctgcgttgggcttgcgccagagaacaacatgatcttggagtacaagtgaaggacaatgaagaaaaagagggacctaagaccttagaacatgaagagttattatgcttcattgttttagtttataaataatttgaattgtggaagagagaggcatatcaagaagcttaagtttaatttgtgtgataatatgatctgagctgtttaatttgtgagaagattaagctaagc

SEQ ID NO: 504 - DNA, 1865 bp, Dandelion
ggggatcatctctctctctctctctctctcctgaaaacactctcactcaaattcgtttcagatttgttagtttgatcgaggattcgagagcaaatatgtttatcgagagctttaaggtagaaagccctaatgttaagtacactgaggatgaaatacactctgtgtacaattacgataccacagagctcgtccatgaggaaaagaacggtgcttatcaatgggttgttaagcccaaaactgtcaaatacgagtttaaaactcaagccaatgttccaaaattaggagttatgcttgtcggatggggaggcaacaatggctcaaccctaaccgccggtgttatcgcaaatcgggagggaatatcttgggcaaccaaagataaagtacaacaagccaactactttggttccttgacccaagcatccaccattagagttggatcctttaatggagaggagatttatgcccctttcaagagcctcctccctatggtgaacccagacgacatcgtttttgggggatgggacataagcagcatgaacttggcagattctatggcaagagctagggttttggacattgatctccaaaagcagttaaggccttacatggagtccatgatcccactccctggaatctttgaccctgatttcatcgctgccaaccaaggctcacgtgctgacaacgtgatcaagggcaacaaaaatgaacaaatccaaaaaatcatcaaagatatcagggagtttaaggaggcaaacaaggtggacaaggtggtggtactgtggactgccaacacagagagatacagcaatgttgtagttgggcttaatgacacggtggaaaatctttttgcgtctatagacaagaatgagtccgagatttcaccatcaaccttgtatgctattgcttgcattcttgaaaatgtgcctttcattaatggcagcccacaaaacactttcgtaccaggggttattgatctggccatccagaaaaacaccttgattggcggagatgatttcaaaagtggtcaaaccaagatgaagtctgttcttgttgacttcctagttggagctggcattaagccaacgtccatagtgagttacaaccatttgggaaacaatgacggaatgaacctttcggccccacaaacattcagatcgaaggagatctcaaaaagcaatgtggttgatgacatggtgtcgagcaatgccattttatatgaaccaggggagcatccagaccatgtggtcgtcatcaagtatgtgccatatgttggagatagcaagagggccatggatgagtacacctcggagatattcatgggtggaacaaacactatcgtgttgcataacacatgtgaggactcccttttggctgctccaatcatcttggacctcgtcctactcgctgagctcagcactcgtatcgaactcaaatctgaaacccagggaaagtttcactcatttcatccggtggccacgattctaagttacctcacaaaggccccgctggtaccaccagggacaccagtggtaaatgcgctagcaaaacaaagggcaatgttggaaaacataatgagggcttgtgtgggactggcaccagaaaacaacatgatcttggaatacaaatgaagtgtgtgaagtgaagtgaagggaagggaagtgaaatgatatgaatatggtttgtatttcttaagattagtgtttttctgttgttgtttggagtttttatgttggtatccacaaatgtaatgtgtgtactttgctttgctttgcttttttgcttggcttagctttaagtcgtaagtaccctttttaatttggagatgaatgaatatattgccaaaataatgccaaaatttgtgattg

SEQ ID NO: 505 - DNA, 1868 bp, Epimedium
tgagttgttgtatttgtttactctttggccctttgatcacattattaacacgagaaccttgattggctgcaatgaatcaagatcatagatcccaggaagtgataacaaaaagtttttcttttgtctattatttgagtttctcaaaccttttctttgttccttcacaaactacgtacgaaaatgtttatagagagtttcaaggttgagagcccaaatgtcaagtacacagaaaatgaagtccaatctgtgtacaattatgagaccaccgagcttgtccacgagagcaggaatggtgtttatcaatgggttgtaaagcctaagaccgtccagtacgagttcaaaactgatacccatgtacctaaactaggggttatgcttgttggatggggaggaaacaatggttcaacccttacaggtggagttattgccaatagacaaggaatctcttgggctaccaaagaaaagtacaacaggctaattattttggctccctcactcaagcatcgagcatcagggtaggatcctttaatggagaggaaatatatgctcctttcaagagcctgctccccatggtgaaccctgacgatgttgtgtttggaggctgggatataagtgacatgaatttggcagatgccatgaccagggcaaaggtgtttgacattgatctccaaaaacagttgaggccctacatggaatccatggtaccacttcctgggatctatgatcttgatttcattgcagccaatcaaggttctcgtgttaataatgtgatcaaagggacaaagagtaaacaaatacaacaactcaggaaggacataagggagttcaaagaggctaacaaggtagataaggttgtggttctctggacagcaaacaccgagagatacagcaatgtcattgtggggttgaatgatacaacggagaaccttttggcttcgatagacaaaaatgaggctgagatttctccttctaccttgtatgccatagcttgtatctatgaagatgttcccttcatcaatggaagcccacagaacacatttgttccaggggttattgatttggctatccaaagaaactgtttgataggaggagatgattttaagagtggacaaaccaagatgaaatcagtcttggtagactttcttgttggcgccggaatcaagccaacatcaattgtgagttacaaccatttgggtaacaacgatgggatgaatctgtcagctcctcaaaccttccggtccaaggagatatcaaagagcaatgttgtggatgatatggttgcaagtaatggtatcttatttgagcctggagaacaccctgatcatgtcatcgtcatcaagtatgtgccatatgttggagatagcaagagagccatggatgagtatacatcagagatattcatgggtggaaagagcaccattgttatgcacaacacgtgtgaggactctttactagctgctcccatcattctggacttggtccttcttgctgagttgagcaccaggatccaactcaaagccgaaggagagggaaaattccattccttccacccagttgctactattcttagttacctcaccaaggcccctctagttccaccaggtactccagtggttaacgccctctccaagcagagagcaatgcttgagaacataatgagagcctgcgttggtctagctccggagaacaatatgattttggaatacaaatgaagtgacagagatggattttgttacctttctaaagagatttgtatgtaagaaatgctttctaggcctattctactgtttatttatttattttttttctgaatttttctctttcagtgaacttcagtacaaaggcacacccgaatttgtaataatgga

SEQ ID NO: 506 - DNA, 1914 bp, Euonymus
cggccgggggagcaaggacttgagattgagaagtgctggggcaagcttgtttggcttagtcttttttgtttggctcagtttttggcgaaattcaagtgggttttgcccccctctggtcctctctctctctcgagcgaaaatgtttattgagaattttaaagttgagagtcctaatgtgaaatacacagagactgagattcattctgtgtacaactatgagaccacagagcttgttcatgagaacaggaatggctcatatcaatggactgttaaacccaaaactgtcaaatacgagttcaagaccgacacaagtgtccctaaattgggggttatgcttgtgggatggggaggaaacaacggttcaacccttaccggtggcgttatagcaaacaaagaaggaatctcttgggcaaccaaggacaaggtgcagcaagccaactattttggctcactaacccaggcatcatcaattcgagttgggtcttaccatggagaagaggtttatgctccattcaagagccttcttcctatggtgaacccagatgagatagtgtttgggggttgggacataagtgacatgaacttggctgatgccatggccagggctaaggtttttgatattgatttgcaaaagcaactaatgccctacatggaacatatggtcccgctccctggaatctatgaccctgatttcattgctgccaatcaggactcgcgtgccaacaatgttatcaaaggcactaagaaagaacaagttcaacaagtcatcaaagacattagggaattcaaggaaaaaaccaaagtggacagggtagttgtgttgtggactgccaacacagaaagatacagtgatgtaatcgtgggcttaaatgatactacggagaatctatttgctgctttggacagagatgaagctgagatctccccttccaccatgtatgctttggcttgcattcttgaaaacattcctttcgtcaatggaagcccacagaacacttttgtgccaggactaattgatttggccataaagaggaacagtttgattggtggagatgattttaagagtggtcagaccaagattaaatctgtgctggttgatttcctcgttggggctggcatcaagccaacatcaatagtgagctacaaccacttgggaaacaatgatgggatgaatctctcagcaccccaaaccttccgctcaaaagaaatctccaaaagtaatgttgttgatgacatggttgcaagcaatggtatcctctttgagcccggtgaacatccagaccatgttgtggtcattaagtatgtgccgtatgttggagacagcaagagggctatggatgagtacacatctgagatattcatgggtggcacaaacacaattgtgatgcataacacctgcgaggactcactcctggctgcacccatcattttggatttagtgctccttgctgaactcagctccaggatccagctcaaagctgaagatgagggaaagttccattctttccaccctgtggctaccattctcagttacctcaccaaggcccctctagttccaccaggcactccagtggtgaatgcactgtcaaagcagcgtgcaatgcttgagaatataatgagagcctgtgttggtctggctcctgagaacaacatgattttggaatacaagtgaaactatagataatcctgggtgttgagagatcatagtgtttctgttttatctggtgcccataattatgaatatttcatatatggagcaagcacctcttttgtgatggaagtcttaaataatgaaagactagaactgtgtttcagcaaaaatgttttgaggattaaactttttgctttcaatcttcttcattagctgacatccccttcctatgacaccagcatcactgctttctttgtctgaac

SEQ ID NO: 507 - DNA, 1864 bp, Euphorbia
tactcctccaaatttcatttcgctctcccaaaatgttcatcgagaagtttcaggtcgagagccctaatgtcaagtacacgaacgacgaggttcactctgtctataactatgaaaccactgagcttgtccacgaatccagaaatgggacttatcagtggattgttaagcccaaaactgttaaataccagtttaaaaccgatctcaatgtccctaaattaggggtcatgcttgtgggatggggaggaaataacggctgtactcttaccggtggggttatagccaacaaagaaggaatctcctgggcaaccaaagacaaggttcaacaagcaaattactttggttcacttacccaagcttcatctattcgtgttgggtctttcaatggagaggaaatttatgctcctttcaagagccttcttcctatggtgaacccagatgacattgtgtttggtgggtgggacattagtgatatgaacctagctgatgctatggcccgcgctagggtctttgagattgatcttcagaagcaattgaggccttatatggaatctatggttcctctccctggaatttatgaccctgatttcattgctgctaatcaaggctcacgtgctaataatgtcattaagggtactaagaaagagcaggttgagcagattagaaaggacattagggagtttaaggagaaaaccaaagtggacagagtggttgtgctttggacagccaacactgagaggtatagcaatgttgctgtggggctaaatgatactatggagaatttattagcttctgtggacaaaaatgaagcagaaatatctccatctaccttgtatgctttggcttgtatttatgaagatattcctttcattaatggaagcccacaaaacacttttgtccctgggctcattgatctggctatcatgaggaactgtttgattggtggtgatgatttcaagagtggtcagaccaagatgaaatctgttctggttgatttccttgttggtgctggtattaagccaacatctatagtgagttacaaccatctaggaaataatgatggtatgaacctgtctgcacctcaaacattcaggtccaaggaaatctcaaaaagtaatgtggtagatgacatggtttccagcaatggaatcctgtacgaacctggtgaacatcctgaccacgttgtggtgattaagtatgtgccatatgtgggagatagcaagagagctatggatgaatacacttcagagatattcatgggtgggaaaagcaccattgttttgcacaacacctgtgaggattccctcttggctgcaccaatcatccttgatctggtcctccttgctgagcttagtactagaatccagcttaaagctgatggggagggaaaattccactctttccaccctgtagctaccattctgagttacctcacaaaggctcctcttgttccgccaggcacaccggtggtgaatgcactgtcgaagcagagggcaatgctcgagaatattctgagagcttgtgttggtttggctcctgagaacaatatgatattggaatacaagtgaagtgcttttatggtagaggaagataaatagttgaggaaaattggtgttcagattctaaaatagaatgccatttagtcatttatttgtttctttctctaattgatccatcatccttgtggttagatgttcatgtgatgttatgttccttccttgatgaacttgtgtgatattgggccattttgtattaattaatgtatggttttgctccaccatcatctttattttgccttttttagagggtgcacatgtaaagcccgtttgcttttgggctagctctttttaatgaatgataatctata

SEQ ID NO: 508 - DNA, 1915 bp, Lettuce
tggcggggactcatcactcatctttctctctccccaaacactcgcactcacattcgtttccgatttcttgtttcatcgagaaatccagagcaaatatgtttatcgagagctttaaggtagaaagccctaatgttaagtacgctgaggatgaaatacactctctgtacaattacgataccacagagctcattcatgaggagaaaaacggtgcttatcaatgggttgttaagcccaaaactgttaaatacgagttcaaaactcaaactcatgttcctaaattaggggttatgcttgttggatggggaggcaacaatggctcaaccctaactgctggtgttatcgcaaatcgggagggaatatcttgggcaaccaaagataaagtgcaacaagccaactactttggttccttgacccaagcatccaccattagagttggatctttcaatggagaggaaatttatgcccctttcaagagccttctccctatggtgaacccagacgacatcgtttttggaggatgggacataagcagcatgaacttggcagattcgatggcaagagctagggttttggacatcgatctccaaaagcagttaaggccttacatggaatccatggtcccactccctggaatctttgaccctgatttcattgctgctaaccaaggctcacgtgctgacaacgtcatcaaaggaaacaaaaatgaacaaatccaaaaaatcatcaaagatatcagggagtttaaggaggcgaacaaggtggataaagtggtggtattgtggacagccaacacagaaagatacagcaatgtggtagttgggcttaacgacacagtggagaatcttttcaaatcaatagacaagaatgaatccgagatttcaccttcaaccttgtatgctattgcttgtattcttgaaaatgtgcctttcattaatggaagcccacagaacacttttgtacctggggttattgatctggccatatcgaagaacaccttgattggtggagacgactttaagagtggtcaaaccaagatgaagtctgttcttgttgacttccttgttggagctggcataaagccaacatcgatcgtgagctacaatcacttgggaaacaacgatggaatgaacctttcggctccacaaacattccgttccaaagaaatttccaaaagcaacgttgttgatgacatggtttctagcaatgccattttatatgagccaggcgagcatcccgaccatgtggttgttatcaagtatgtgccatatgttggagatagcaagagagcaatggacgagtacacatccgagatattcatgggaggtacaaacactattgtgttacataacacatgtgaagactcgcttttggctgctccaatcatcttggaccttgtcctactcgctgagctcagcactcgtatccaactcaaagctgaaaccgagggaaagtttcactcttttcatccggtggctaccattctaagttacctaacaaaggcccctcttgtgccaccagggacaccagtggtgaatgcactagcaaaacaaagggcaatgttggaaaacataatgagggcttgtgttggattggcaccagagaacaacatgatcttggaatacaaatgaagtgtgaagtgaactgaaagtgaagatgaaagtgatatgaatatggtttgtatttcttaagattagtgtttttctgtgttgttgtttgaagttttcttatgttggtaaccacaaatgtaatgtgtgtacttttgctttgctttgcttttttgcttagcttagctttaagaagtaagtacccttttaatttggaaatgaatgaatatatattgcaaaaataatgccaaattttgtagtgaatttgcatgtgatcaaatctaaaaacaacagaaaaaaaaacgcctgtc

SEQ ID NO: 509 - DNA, 2680 bp, Poplar
gatggagcacaagaaagaaagggtcagaggctagttaagattagtggcaacgcagtcttggtttccatttttgttttctcattctttgatctcgtgatatttgtttttcttttctatagcaaagaaagcaaaaatgtttattgagaagtttaaggttgagagtcctaacgttaagtacatagaggatgagattcattccgtttacaactacgaaaccactgaacttgttcatgagaacagaaatggttcttatcaatggactgtcaagcccaaaactgtccaatatgaattcaagactgacattcgtgtccccaaactaggtgttatgcttgtggggtggggaggaaacaatggttcaactctcactggaggtgttattgccaacaaagaaggaatctcctgggcaactaaggacaaggtgcagcaagccaattactttggatcacttacccaggcatcaagcatcagacttgggtctttcaatggagaggagatttatgctccattcaagagcttgctccccatggtgaacccagatgacattgtatttgggggatgggacataagtgacatgaacttagcagatgccatggcgagggccaaggttttcgatattgacttgcaaaagcaattgaggccctacatggaatccatggtacccctccctggaatttacgaccctgatttcattgctgccaatcaaggctcacgtgctaacaatgtcatcaaaggcaccaagaaagaacaacttcagaaaattatggaagacatcagggaatttaaggaggcaaacaaggtggacaaggttgttgtgttgtggactgccaacacagagagatacagtaatattgttgtggggctaaatgacaccatggagaacctcctggctgctgtggagaaggatgaatcagagatatctccatcaaccttgtttgctctggcttgtattaatgaaaatatacctttcatcaatggaagcccacaaaacacttttgttccaggacttattgatctggctattaagaggaacagtttgattggtggagatgactttaagagtggtcagaccaagatgaaatctgtgctggttgatttccttgttggggccggtattaagccaacatcaatagtgagttacaaccatctgggaaacaatgatggcatgaacctctcagcacctcaaaccttccgctccaaagaaatctccaagagcaatgttgttgatgacatggtctctagcaatggaattctgtatgagcctggtgaacaccctgaccatgttgtagtcatcaagtatgtgccatatgttggagatagcaagagagctatggatgagtacacctcagagatattcatgggtggccaaaacaccattgtgatgcacaacacctgtgaagactccctcttggctgcaccaatcatcctggatttggttcttcttgcagagcttagcaccaggatccagttcaaaggtgaagcagagggcaagttccactctttccaccctgttgctactattctcagttaccttacgaaggctcctcttgttccaccaggcacaccagtggtgaatgctctgtcaaagcagcgtgcaatgcttgagaacatactgagagcttgtgttgggttagctcctgagaacaacatgattttggaatacaagtgagctagtggaagaagataacagtggacgtagtttggttcaggaacaaaaaacaaccacccaatttccctttctctttcactaatcctgtggttaagtgatgccttttttttctgtaatgtaatatttgtgttatattttcattaatgttttatgtatggattttgctgtttattttacggagctcatgtagcccgattgctttggctcatcatgaccaagaacctttttctaggcgaaatagatgatctatatatatatggaaacagtccatgagctgtgtttgttggagcaaaatcaagtaatatcattctatactttactaaagttgttctcttcctttttggaccttttttcttctaattaccttgtcagggatccatgtttttgcgttttttactcgactttaccaagaaccgttgagggtatagcgttttctgagaaatactgtgcattctcctttcttaactgtgggacttgttcaaacggaccagtttcttgtattgatcaccttaaattctatgataggtcacttgatattcgatgaacacattgattgatgcccgccttatggagtgccacggtaaagggcaaaaatatttcaatggtcccagctctcttctctccattgccatacatatggagtccccattatttgaacccttcagggttatatctataaggtccacaattttttcggtagaccagtcaacgtatacgtggacagctcatgctttgtggggctaatcattatttcatgctgaaagttttggatcgtgtgatcatctgtgttgcctgcaatcctgggaagcaggtgggtggccaaggctgttggagataatgctgtggacctggagaaattttctgcaccagatcatgagattcttacagaacgaaggaccatttcagttctctagttttctttcgtttctttgtcattttttattcaacttctgcaaaatataatagtgtctttccatttattgagctcaattttgtttaggatgaatctaactg

SEQ ID NO: 510 - DNA, 1900 bp, Radish
gagagagagaragagagcgaagatgttcatcgaragcttcaaggtagagagcccaaacgtgaagtacacagagaatgagatccattctgtgtacgactacgaaaccacagaggtcgtccatgagaaccrtaacggtacttaccawtgggtcgtcaagcccaaaaccgtcaaatacgawttcaaaacmgacacacgtgtccccaagttaggggttatgcttgttggctggggaggaaacaacggatcgaccttaaccgctggtgtgattgccaacaaagaagggatctcgtgggcgactaaagacaaagtgcaacaagccaactactttggctcgctcactcaagcttcttcgatccgggtcggatcttacaatggcgaagagatctacgctcctttcaagagtcttctccccatggtgaacccagacgatgttgtgttcggtggttgggacataagcgacatgaacttagcagacgccatggctagagcmagagtccttgacattgatctccagaaacagctaagaccttacatggagcacatggtcccgctccctggtatctacgatcctgatttcatcgctgcsaaccaagggtcacgtgccaatagcgtgatcaaaggtacyaagaaagaacaagtcgaccagatcatcaaggacatgagggagtttaaggagaagaacaaagtggataagctggttgtsttgtggacagccaacacrgagcgttacagcgatgtggttgtagggcttaacgatacgatggagaatctsttggcttctgttgagaagaacgagtcmgagatctctccttctackctttatgckatmgcttgtgttcttgaagggattccttttattaatgggagtcctcagaacacgtttgttcctggactcatcgagctggctatatcgaagaactgtttgatcggtggggatgatttcaagagtggtcagactaagatgaagtctgttctggtcgatttcctcgtcggagctggcatcaagcctacttcgattgtgagctataatcatttgggaaacaatgacggcatgaacctctcagcgccgcagactttcagatcaaaggagatctcgaagagcaatgtggtagacgacatggtggctagtaacggcatactctttgagcctggtgaacatcctgaccatgttgttgtcatcaagtatgtaccttatgttggggatagtaagagggctatggacgagtacacctccgagatattcatgggagggaagaacacaattgttatgcataacacctgtgaggattctcttttggcggctccaatcatcttggatcttgttcttctcgctgaactcagcaccagaatccaattcaaagccgaaggagaggggaagttccactctttccacccagtagctaccatactcagttacctcacaaaagcacctcttgtaccacccgggacgccagtggtgaacgctctatctaagcagagggctatgttggagaacatcctcagggcctgcgttgggcttgcaccagagaacaacatgatcttggagtacaagtgacaaggaagaaataaaagcagagggacctgagacgcttgagagttatatttttaatgcttcattgtttcgttttatatgtaataattgcgtgagagagaaacatatcaagaagtttaaggttaatctgagtgatagtgatccttggcagttttactatgtgagaagattagctaagcttctggatcaaatgtgtaatagatgtcagatttcaaagtagttatgtctgtccctccttgtcttatgatctattaaaatgggtttctgtagttctgtttcatgtgtcgtgtaacttcttcaccaaacagagacatcaataaagaacataacaaggcatgaaaacttcga

SEQ ID NO: 511 - DNA, 1810 bp, Tragopogon
ctctctctctctctccctaaacactccactcaaattcgtgttttgatctagaaatcgagagcgaatatgtttatcgagagcttcaaggtagaaagctctaatgttaagtacactgagaatgagatacaatctctctacaattacgataccacagagctcgttcatgaggagaaagacggagcttatcaatgggttgttaggcccaaaactgtcaaatacgagttcaaaactcaaactaatgtccctaaattaggggttatgcttgttggatggggaggcaacaatggctcaaccctaactgctggtgtcatcgcgaatcgggagggaatatcttgggcaaccaaagataaagtgcaacaagccaactactttggttcattgacccaagcatccaccatcagagttggatccttcaatggagaggagatctatgcccctttcaaaagcctcctccctatggtgaacccagacgacattgttttcgggggatgggacataagcagcatgaacttggcagattccatggcaagagctagggttttagacattgatctccaaaagcagttaaggccttacatggaatccatggtcccacttccgggtatctttgaccccgatttcatcgctgccaaccaaggctcacgtgcagataacatcatcaaaggaaccaaaaatgaacaaatccaaaaaatcatcaaagatatcagagagtttaaggaggcaaacaaggtagacaaagtggtggtactatggaccgccaacacagaaagatacagcaacgtggtagtcgggcttaacgacacagtggagaacctttttgcatctatagacaagaatgaatccgagatttctccttctactttgtacgctatcgcgtgtattcttgaaaacgtgcctttcattaatggcagcccacaaaacactttcgtaccaggggttattgatttggccatcaagaagaacactttgattggtggagatgattttaagagcggtcaaaccaagatgaagtctgttcttgttgatttccttgttggtgctggcattaagccaacatcgattgtgagctacaaccacttgggaaacaacgatggaatgaatctttcggctccacaaacattccgatccaaggagatttccaagagcaacgttgttgatgacatggtttctagcaatgccattttatatgagcccggcgagcatcccgaccatgtggtcgttatcaagtatgtgccatatgttggagatagcaaaagggcaatggatgagtatacatctgagatatttatgggaggtacaaacactattgtgctccacaacacatgtgaagactcccttttggctgctccaatcatcttggacttggtcctactcgctgagctcagcacccgtatccaactcaaatctgaaaccgaggggaaattccattcgtttcatccggtggccacgattctgagttacctaacaaaggcccctcttgtaccaccagggacaccagtggtgaatgcactagcaaaacaaagggcaatgttggaaaacataatgagggcttgtgttggattggcaccagaaaacaacatgatcttggagtacaaatgaagtggaagttatttaagaaaatatggtttgtgtttcttaaaatgttagtgtttttgtgtttattgtttggactttttttattttattttatctttgttttcacaactgtaatgcgtgtacttttgctttgctttgctttaagaagtaattattacctctttatttggagatgaatgaatatattctcaaaataattccatattttgtggtc

SEQ ID NO: 512 - DNA, 1538 bp, Wheat
atgttcatcgagagcttcaaagttgagagcccaaacgtgaagtacacagagaacgagatccattctgtgtacgattacgaaaccacggaggtcgtccatgagaaccgtaacggcacttaccaatgggtcgtcaagcccaaaaccgtcaaatacgatttcaaaacagacactcgcgtccccaagctaggcgttatgctcgttggatggggaggaaacaatggatcaaccttaaccgctggagtgatcgccaacaaagaagggatctcgtgggcgactaaagacaaagtgcaacaagcaaactactttggctccctcactcaagcttcttcgatccgggtgggatcttacaatggtgaagagatctacgctcctttcaagagcctcctccccatggtgaaccctgacgatgttgtgtttggtggttgggacataagcgacatgaacttagcagacgctatggctagagcaagagtccttgacattgatctccagaaacagctcaggccgtacatggagcacatggtcccactccctggtatctacgaccctgacttcatcgctgcgaatcaagggtcacgtgctaatagcgtgatcaaaggtaccaagaaagaacaagtcgaccagatcatcaaagacatgagggagtttaaggagaagaacaaggtggataagctggttgttctgtggacagccaacacagagcgttacagcgatgtggtcgtagggcttaacgacacgatggagaatctattggcttctgttgagaagaacgagtctgagatctcgccttctacgctatatgcgattgcttgtgttcttgaaggcattcctttcattaatgggagtccgcagaacacgtttgttcctggactcatcgagctggctatatcgaagaactgtttgatcggtggggatgacttcaagagtggtcagactaagatgaagtctgttttggttgatttccttgtcggagctggcatcaagcctacttcgattgtgagctataatcatttgggaaacaatgacggcatgaacctctcagcgcctcagacttttagatctaaggagatctcaaagagcaatgttgttgacgacatggtggctagtaacggtatcctctttgagcctggtgaacatcctgaccatgttgtcgtcatcaagtatgttccttatgttggggatagtaagagagccatggacgagtacacctcggagatattcatgggagggaagaatacgattgttatgcataacacttgtgaggattctcttttggctgctccaatcatcttggatcttgttcttctcgctgagctcagcaccagaatccaattcaaagctgaaggggaggggaagtttcattctttccacccagtagcaaccatactcagttacctcacaaaggcacctcttgtaccagccgggacacctgtggtgaacgctctatctaagcagagggctatgctggagaacatcctcagggcctgcgttgggcttgcgccagagaacaacatgatcttggaatacaagtgaacacg

SEQ ID NO: 513 - DNA, 1599 bp, B. juncea
aatgttcatcgagagctttaaagtcgagagcccgaacgtgaagtacacggagaatgagattcaatcggtgtacgattacgagaccacggaggtcgttcacgagaacgttaacggtgcttatcagtggatcgtgaagcctaaggttgtcaaatacgatttcaaaaccgacactcgtgtccccaaattaggggttatgcttgtgggttggggaggaaacaatggatcaaccctcaccgccggtgtaattgcgaataaagaaggaatctcgtgggcgaccaaggacaaagtgcaacaagctaactacttcgggtcgttaacacaagcatcgtctattcgggtcggatcctttaacggtgaagagatctatgctcctttcaagagtctcgttccaatggtgaatccggatgatgttgtgtttggaggatgggacataagtgatatgaatttagcagacgccatggggagagccaaggttcttgacatcgatttgcagaaacagctcaggccttacatggagaacattgtcccactccctgggatcttcgatcctgatttcatcgctgctaaccaaggctcacgtgccaacaacgtcatcaaaggtaccaagaaagaacaagtcgaccaaatcatcaaggacatgagggagtttaaggagaagaacaaggtggataaggttgtggttctatggacggctaacacagagcgttacagcaatgtgatcgtcggtctaaacgacaccatggagaatcttatgaactctgtggatagggatgagtctgagatctctccttccacgctttatgcgattgcatgtgttcttgaaggcatccctttcatcaatggaagccctcagaacaccttcgttccaggtcttattgatttggctatcaagaacaatgttttgatcggtggagatgacttcaagagtggtcaaaccaagatgaaatccgtcttggttgatttccttgttggtgctggaatcaagcctacttcaatagtgagctacaatcacttagggaacaacgatggaatgaacctctcagctccacagacattcagatctaaggagatctctaaaagtaatgtggtggacgatatggttgctagcaacggtatcctctttgagcccggggaacaccctgaccatgtagttgtcatcaagtatgtaccgtatgttgcagatagcaagcgagccatggatgagtatacatcagagatattcatgggtggcaagaacacaattgtgatgcacaatacctgcgaggactctctcttagctgctccaattatcttggatcttgttctcctcgctgaactcagcaccaggattcagttcaaatccgagaaggaggggaagtttcattctttccatccagtggccaccatactcagctacctcaccaaggcaccgctcgtgccgccgggaacaccggtggttaatgcgctgtctaagcagcgggctatgctggagaacattcttagggcgtgcgttggactggctccggaaaacaacatgatcttggaatacaagtgaacatgaagcgtttaagaacctttagtgagttcatgatataagacttttatgttcctatgtttggt

SEQ ID NO: 514 - DNA, 1856 bp, Canola
taaaaaccgagaaaacaaaagtctgtttaaaagatgttcatcgagagcttcaaagtcgagagcccgaacgtgaagtacacggagaatgagattcattcggtgtacgattacgagaccacggaggtcgttcacgagaacgtcaacggtgcttaccagtggatcgtgaagcccaaggttgtcaaatacgatttcaaaaccgacactcgtgtccccaaattaggggttatgcttgttggttggggaggaaacaatggatcaaccctcaccgctggtgtaattgccaataaagaaggaatctcgtgggcgaccaaggacaaggtgcaacaagcgaactacttcgggtcgttaacacaagcatcgtctattcgtgtcggatcctttaacggtgaagagatctatgcccctttcaagagtctcgttccaatggtgaatccggatgatgttgtgtttggaggatgggacataagcgatatgaatttagcagacgcgatgggtagagccaaggttcttgacattgatctgcagaaacagctcaggccttacatggagaacattgtcccactccctgggatctacgaccctgatttcatcgctgccaatcaaggctcacgtgccaacaacgtgatcaaaggtaccaagaaggaacaagtcgaccaaatcatcaaggacatgagggagtttaaggagaagaacaaggtggataaggttgtggttctgtggacggctaacacagagcgttacagcaatgtgatcgtggggctaaacgacactatggagaatcttatgaactctgtggatagggatgagtctgagatctctccttccacgctttatgctattgcatgtgttcttgaaggtattcctttcatcaatggaagccctcagaacacctttgttccgggtcttattgatttggctatcaagaacaatgttttgatcggtggagatgacttcaagagtggtcaaaccaagatgaaatctgtcttggttgatttccttgttggtgcaggcatcaagcctacttcaattgtgagctacaatcacctagggaacaacgatggaatgaacctctcagctccacagacattcagatctaaggagatctccaaaagtaatgtggttgacgatatggttgctagcaacggtatcctcttcgagcccggggaacatccagaccatgtagttgtcatcaagtatgtaccgtatgttgcagatagcaagcgagccatggatgagtatacatcagagatattcatgggaggcaagaacacaattgtgatgcacaatacctgcgaggactctctcttagctgctccaattatcttggatcttgttctcctcgctgaactcagcaccaggattcagttcaaatccgagaaagaggggaagtttcattctttccatcctgtggccaccatacttagctatctcaccaaggcaccgctcgtgccgccgggaacaccggtggttaatgcgctgtcgaagcagcgggctatgctggagaatattcttagggcgtgtgttgggctggcgccggagaacaatatgatcttggaatacaagtgaacacgaagcgtttaagaatctttaattagcccaaaatataagacttctgtttcttgtttttttttaatatatgttttaaaatatgaatgcttgtgttttcagagatcaaagagcttttagattgatctttgtagggtgtgaagttaccggtgtttctagtaatccagatgggctagtataatgtacaagtgtttctagattggaccataatttcatataatcgcttttatgattcacttccataatgtgtaaacttactgtaatttgcgatatttagtcatggtttcggt

SEQ ID NO: 515 - DNA, 1953 bp, Euonymus
ggtgagcaaggacttgagattgagaagtaccggggcaagcttgtttggcttagtcttttttgtttggctcagttttttgcgaaattcaagtgggttttgcccccctctggccctctctctctctcgagcgaaaatgtttattgagaattttaaagttgagagtcctaatgtgaaatacacagagactgagattcattctgtgtacaactatgagaccacagagcttgttcatgagaacaggaatggctcatatcaatggactgttaaacccaaaactgtcaaatacgagttcaagaccgacacaagtgtccctaaattgggggttatgcttgtgggatggggaggaaacaacggttcaacccttaccggtggcgttatagcaaacaaagaaggaatctcttgggcaaccaaggacaaggtgcagcaagccaactattttggctcactaacccaggcatcatcaattcgagttgggtcttaccatggagaagaggtttatgctccattcaagagccttcttcctatggtgaacccagatgagatagtgtttgggggttgggacataagtgacatgaacttggctgatgccatggccagggctaaggtttttgatattgatttgcaaaagcaactaatgccctacatggaacatatggtcccgctccctggaatctatgaccctgatttcattgctgccaatcaagactcgcgtgccaacaatgttatcaaaggcactaagaaagaacaagttcaacaagtcatcaaagacattagggaattcaaggaaaaaaccaaagtggacagggtagttgtgttgtggactgccaacacagaaagatacagtgatgtaatcgtgggcttaaatgatactacggagaatctgtttgctgctttggacagagatgaagctgagatctccccttccaccatgtatgctttggcttgcattcttgagaacattcctttcgtcaatggaagcccacagaacacttttgtgccaggactagttgatttggccataaagaggaacagtttgattggtggagatgactttaagagtggtcagaccaagattaaatctgtgctggttgatttcctcgttggggctggcatcaagccaacatcaatagtgagctacaaccacttgggaaacaatgatgggatgaatctctcagcaccccaaaccttccgctcaaaagaaatctccaaaagtaatgttgttgatgacatggttgcaagcaatggtatcctcttcgagcctggtgaacatccagaccatgttgtggtcattaagtatgtgccatatgttggagacagcaagagggctatggatgagtacacatctgagatattcatgggtggcacaaacacaattgtgatgcataacacctgcgaggactcactcctggctgcacccatcattttggatttagtgctccttgctgaactcagctccaggatccagctcaaagctgaagatgagggaaagttccattctttccaccctgtggctaccattctcagttacctcaccaaggcccctctagttccaccaggcactccagtggtgaatgcactgtcaaagcagcgtgcaatgcttgagaatataatgagggcctgtgttggtctggctcctgagaacaacatgattttggaatacaagtgaaattatggataatcctgggtgttgagagatcatagtgtttctgttttatctggtgcccataattatgaatattttatatatggagcaagcacctcttttgtgatggaagtcttaaataatgaaagactagaactgtgtttcagcaaaaatgtttgaggattaaacttttcgctttcaatcttcttcattagctgacatccccttcctatgacaccagcatcactgctttctttgtctgaatcacattttgcttcaatggagtaaaaatgtgtcatggtggtgtgtac

SEQ ID NO: 516 - DNA, 1964 bp, Strawberry
gaaagagcagattgagattgagaggcagtagtagcattcccagagagagagagagagcgagattttcatttttccggcgaaaacaaaccagaaaagaagatgttcattgagagctttaaggtcgagtcccctaacgtagagtacactgagaatgagattcattctgtgtacacctacgagaccactgagcttgttcatgagaacaggaagggtacttatcagtggattgttaagcccaagtctgtgaaatacgaattcaagactgatgtgcatgtccccaaattaggggtaatgcttgtgggatggggtggaaacaatggctcaaccctcactgctggtgtgattgctaacagagaaggaatctcttgggcaaccaaggacaaggtgcaacaggccaattactttggctcactcacacaagcctcgtcgattcgtgttgggtctttcaatggggaagagatttatgctccattcaagagccttcttcccatggtgaaccctgatgacattgtgtttgggggttgggacatcagtgacatgaacttagctgatgctatggccagggctagagtcctggacattgatctgcaaaagcagctcaggccttacatggagtcgatgatcccactccctggaatctatgaccctgatttcattgctgctaatcaaggttcgcgtgcaaacaacgtgatcaagggtactaagcaggaacaagtccaacagatcatcaaagacattagagagttcaaggagaagaacaaagtggacaaggtggtcgtgctttggactgccaacactgagaggtacagtagtgtgattgaggggctaaacgacaccgttgagaaccttttgggttcagtggagaagaatgaagctgagatatccccttccaccttgtatgccatagcttgtgtgatggaaaatgtccctttcatcaatggaagcccacaaaacacatttgtcccagggctcattgatttggctattaggaggaatactttgatcggtggggatgactttaagagtggtcagaccaaaatgaaatctgttctggttgatttcctagttggagctggtatcaagccaacatcaattgtgagctacaaccatcttggaaacaatgatggtatgaacctttcagctccgcaaaccttcaggtccaaggaaatttccaagagcaatgttgtggatgatatggtgtcgagcaatggcatcctcttcgagcctggtgagcaccctgatcacgttgtggtgatcaagtatgtgccctatgtggctgatagcaagagagctatggatgagtacacatctgagatattcttgggtgggaggaacaccattgtgatgcacaacacctgtgaggactccctcttggctgctcctatcattctggatttggttctgcttgctgagctgagcactcgtatccagctcaaatctgaagctgaggcaaagttccactctttccaccctgtggctactattctaagttacctcaccaaggcacctcttgttccaccaggtacaccagtggtgaatgcactctcaaagcagagggcaatgcttgagaacatactcagagcttgtgttggcttggctccagagaacaacatgatcttggagtacaaatgaagcaacctagctagctagctagagatattcaaagatgattcaagtgattcaaattattcaagaattatcactctttctctctctctcgctttctcttttatttagtgtggtgttcacagatggtgtgagtagtcttttaattttctatctggagaaggttcccatggcatgtgtgcagtgcagttgcttctagctcattcagaagcaaagcaactcttttgtaatggaaatataatggataatattggacagtttaattatgtgcccaatctggcaccttcattttatatcccttccacagttactacatatatattcaagctgcaaattta

SEQ ID NO: 517 - DNA, 1994 bp, Thellungiella parvulum
ctcaaacccacacaaaattcgagcaaaaccaagaaacaaagttgattgttgttaattttctctgtaaattttctcgggaaaaaaaatgttcattgagagctttaaagttgagagccccaacgtgaagtacacagagaatgagattcagtcggtgtacgattacgagacaacggaggttgttcacgagaacatcaacggtacttaccaatggattgtgaagccaaaggttgtcaaatacgatttcaaaaccgatactcgtgtccccaacttaggggttatgcttgtgggttggggaggaaacaatggatcaaccctcaccgccggtgtaattgcgaataaagaaggaatctcgtgggcgacgaaggacaaagtgcaacaagcgaattacttcgggtcactaacccaagcatcatcgattcgtgtcggatccttcaacggtgaagagatctatgctcctttcaagagtctccttccaatggtgaatccggatgatgttgtgtttggaggatgggacataagtgatatgaatttagcagacgccatgggtagagccaaggttcttgatattgatttgcagaaacagcttaggccttacatggagaacattgtgccactccctgggatctacgatcctgatttcatcgctgcaaatcaagggtcacgtgccaacaacgtcatcaaaggtaccaagaaggaacaagtcgaccacatcatcaaggacatgagagagtttaaggagaagaacaaggtggataaggttgtggttctatggacggctaacaccgagcgttacagcgatgtgatcgttgggcttaacgacacaatggagaatcttatgaactctgtggatagggatgagtccgagatctctccttcgacgctttatgctattgcatgtgtacttgaaggcatcccgttcatcaatggaagccctcagaacacctttgttccaggtcttatcgatttggctattaagaacaatgttttgatcggtggagatgatttcaagagtggtcaaaccaagatgaaatctgtcttggttgatttccttgttggtgcaggaattaagcctacttcaattgtgagctacaatcacttggggaacaacgacggaatgaacctctcagctccacagacattcagatctaaggagatctcgaaaagcaatgtggttgacgatatggttgctagcaacggtatcctcttcgagcccggggaacacccagaccatgtagttgtcatcaagtatgtaccgtatgttgcagatagcaagcgagcgatggatgagtatacatcagagatattcatgggagggaagaacacaattgtgatgcacaatacctgcgaggactccctcttagctgctccaattatcttggatcttgttctcctcgctgaactcagcaccaggattcagttcaaatccgagggagaggggaagtttcattcttttcatcctgtggccaccatactcagctacctcaccaaagcaccgctcgtgccgccgggaacacctgtggtcaatgcactgtcgaagcagcgggcgatgttggagaacattcttagggcatgcgttgggctggcgccggaaaacaacatgatccttgaatacaagtgaccaagaagcttttaagaacttttaattagctcatattacaagactcttgtgttccttttgtttttccttattatatgttttaaaatatgaatgtttgtgttttcagagatcaaagagcttttagtttgatctttgtagggtgtgaagtagcttgtatttctagtaatccggatgggttagtatattgtgcaagtgtttttaggttggaccggaatttcataatcgcgttacgatccagtttcattatgtgtgtaaacaacttatattttgagatatttaatcatggttttggtccaaaaattttcaattttagtttcatattattattttattatagttaagaaatccgatctggttatgcagaaatgacaagcaa

SEQ ID NO: 518 - DNA, 1912 bp, Thellungiella parvulum
aatgtccatctggtctataaaagacgagcttggtctgaaatatcaatgcattcagaagcaaacaattctgaaactttcattgagaaaaaaatattaggcaaaaatgttcatcgaaagcttcaaggttgaatctccaaacgtgaagtacacagagaatgagattcattcagtgtacgactaccaaaccactgagcttgttcacgagagcaaaaacggtgcgtatcaatggatcgtgaagccaaaaaccgtgaaatatgagtttaagaccgacactcatgttcccaaacttggagtgatgctcgttggttggggagggaacaatggttctactcttaccgctggtgttatcgccaatcgcgagggaatatcctgggctaccaaggagaaagtgcaacaagctaattatttcgggtcattaacccaagcatcctctattcgggtcgggtcatttaatggcgaagaaatctatgctcccttcaaaagtcttctccccatggtgaacccggaagaaatagtgtttgggggatgggacatcagcgacatgaacttagcagacgcgatggcacgagccaaggttctagatatcgacctccaaaagcagctgcgtccgttcatggaacacatggtccctctccctggaatctacgatccagatttcatcgcagctaaccaggggtcacgtgccaaccacttgatcaagggcaccaagaaacaacagctcgaacaagtcatcaaggacatcagggatttcaaagagaaaaacaaagtggataaggtggtggtgttgtggacggcgaacacagagagatacagcaatgtggtggctggtcttaacgacacgacggagaatcttatgtcatctttggacaacaacgagtctgagatttctccttctacactttacgccattgcttgtgttattgagaacgttcctttcatcaatggaagcccacaaaacacttttgtccctgggcttattgaattggcaatcaagagaaacagcttgatcggtggtgatgacttcaagagtgggcagaccaagatgaagtctgtcctcgtcgatttccttgtcggcgctggaatcaaaccaacgtcgatagtgagctacaaccaccttgggaacaacgacggcatgaatttgtcggcgccacaaacattccggtcaaaggagatatcgaagagcaatgtcgtcgacgatatggttgctagcaacggtattttatacgagtccggtgaacatcctgaccatgttgtcgtcattaagtatgtgccgtatgtaggagacagcaagagagccatggacgagtacacatcagagatattcatgggagggaagaacacgattgttatgcacaacacttgtgaagactctcttttggctgctcctatcattttggaccttgttcttctcgccgagctcaccacccggatcgagttcaaggccgaaactgagggaaagttccattctttccatccggtggctacaatcctgagttacctctccaaggcaccattggtcccacctggcacgccagttgtgaacgctttgtcgaaacagcgtgcaatgcttgagaacatactcagagcttgtgtcggacttgctccagagaacaacatgattctcgagtacaagtgaagaagagaccaatcatgagagagatcaacaattaagatccgattcatttagctttgcctttttcttgatgttttaatgaataattacatttttaaaatgtaagttttgatttcttgttatacaaactatctcgcgctgaattggattttcttccatcttatttaaaaatctttaataaaagtgagctttggtttacacatttatagttttttgaaataaaatgataattccatttcatttgagaacataactagaccaaaactaatccttcttttt

SEQ ID NO: 519 - DNA, 1773 bp, Cucumber
ctccaaaaacccatatcaaaatgttcatcgatagctttaaggttgaatcccccaatgttacttactccgatcatgagattcattccatttacaattacgaaactacagagctccttcatgagaacagaaatggaacttatcatggattgtcaaacccaaatccgttcaatatcaattcaagactgatattcgtgtccccaaattagggatgatgcttgtcggatggggtggaaacaatggctgtactctcactggtggtatcattgccaatcgggaagggatttcttgggcaactaaggataaagttcagcaagctaattattttgggtccttaactcaagcatcttccatcagggttggttctattgatggtgaagagatctatgctccttttaagagcctacttcctatggtaaatcctgatgatgttgtgtttggagggtgggacataagtgacatgaacttggctgacgccatggctagagccaaggttcttgatattgatttgcaaaagcaattgagaccttacatggaatccatggtcccgcttcctggaatcttcgatcctgattttgttgctgccaatcagggctcacgagccaataatgttatcaaaggcaccaagaaagaacaacttcagcaaattattaaagatatcagggaatttaaggagaagagtaaggtggacaaaattgtagtgctgtggactgccaacacagagaggtatagtaatgtgattgtggggctaaatgacactatggaaaatcttctggcttctgtggacaaaaacgagtcggagatatctccttccacattgtatgcaattgcttgtgtccttgaaaatgtccctttcatcaatggtagcccacagaacacttttgtcccagggttgattgatttagccatccatagaaatagtttgattggtggggacgattttaagagtggtcaaactaagatgaaatctgttctggtcgactttcttgttggtgctggtattaagccaacatcaatagtgagctacaaccatctgggaaacaatgatggaatgaatctctcagctcctcaaaccttcagatccaaggaaatctcaaagagtaatgtcgttgatgacatggtctccagcaatggcattctctatgagcctggcgagcatcctgaccatgtggtggtgatcaagtatgttccttatgtcgccgatagtaagagggccatggatgagtacacttcagagatattcatgggtgggaaaagcaccatagtgttgcacaacacatgtgaggactctctcttggcggctccgattatacttgatttggttcttcttgctgaactcagcactcgcattcaattcaaggccgaaggagagggaaagttccactctttccaccctgtggccaccatcctcagttaccttacaaaggctccacttgtaccgccaggcacgcctgtggtgaatgctttatcaaagcagcgcgcaatgcttgagaatataatgagagcttgtgttgggttggcacctgagaacaacatgattttggagtacaagtgaagtctgaaaagtgttttaagttcgatagaagttggttttatatatataagtttgtgaaaatatgcaattagtttgtgtttggtccttttttcagcctttttcttttctttaagccctctttttgtattaggcttggggaagctgcttaatcttgggctacgtatgtctgtaatggaattatacatattttaaataaattagatctttatgtttttggtaaa

SEQ ID NO: 520 - DNA, 2001 bp, Thellungiella halophilum
agaagctcaaacccacacaaaaccgattaaaacagagaaacagaagttaatcatcatcatttcctcagattttattatctgcttaagattttctaaaatgttcatcgagagctttaaagtagagagtccgaaccgtcaagtacacagagaatgagattcagtccgtgtacgattacgagacgacggaggttgttcacgagaacgttaacggtactttccaatggattgtgaagccaaagactgtcaaatacgatttcaaaaccgatactcgtgtccccaaattaggggttatgcttgtgggttggggaggaaacaacggatcaacactcaccgccggtgtaattgcgaataaagaaggaatctcgtgggcaacgaaggacaaagtgcaacaagcgaattacttcggatcactaactcaagcatcatctattcgggtcggatcctacaacggtgaagagatctatgctcctttcaagagcctccttccaatggtgaatcctgatgatgttgtgtttggaggatgggacataagtgatatgaacttagcagacgccatgggaagagccaaggtccttgacattgatttgcagaaacagctcaggccttacatggagaacattgtgccactccctgggatctacgatcctgatttcatcgctgcaaatcaaggttcacgtgctaacaacgtcatcaaaggtaccaagaaggaacaagtcgaccgcatcatcaaggacatgagggagtttaaggagaagaataaggtggataaggttgtggttctatggacggctaacacagagcgttacagcaatgtgatcgtcgggctaaacgacacaatggagaatcttatgaactctgtggatagagacgagtctgagatctctccttcgacgctttatgctattgcttgtgttcttgaaggcatccccttcatcaatggaagtcctcagaacacctttgttccaggtcttattgatttggctatcaagaacaatgttttgattggtggagatgatttcaagagtggtcaaaccaagatgaaatctgtcttggttgatttccttgttggtgcaggaatcaagcctacttcaatagtgagctacaatcacttggggaacaacgatggaatgaacctctcggttccacaaacattccgatctaaggagatctcgaaaagtaatgtcgtggacgatatggttgctagcaacggtatcctctttgagcccggtgaacacccagaccatgtagttgtcatcaagtatgtaccatatgtggcggatagcaagcgagcaatggatgagtatacatcagagatattcatgggagggaagaacacaattgtgatgcacaatacctgcgaggactctctcttagctgctccaattattttggatcttgttctcctcgcggaactcagcaccaggattcagttcaaatccgaaggagaggggaagtttcattctttccatcctgtggccaccatactcagctacctcaccaaggcaccgctcgtgccgccaggaacaccggtggttaatgcgttgtcgaagcagcgggcgatgcttgaaaacattatgagggcgtgcgttgggctggcgccggaaaacaacatgatcttggaatacaagtgaaacaagaagcatttaagaacctttcatttgctcataatataagacttttgtgttcctttgtttggtttttaaattatatgttttaaattatgaaggcttgtgtgtttcagagatcaaagagcttttagtttgatctttgtagggtgtgaagtatcttgtaattgtagtagtccgaatgtgctgcaagtgtttcaagctaggttggaccatagtttcatatttatgattcggtttcatgtgtgtaaacaccttatattaatctgagatattcaatcatggttccggtcctctgaaatttgtcaattctagtttcgtattattatcttattgtaaatgagaaaattctgtcaagttatctagaaacttgcaa

SEQ ID NO: 521 - DNA, 1854 bp, Eschscholzia
ctccttcttcttcttggtagttgttaagatcaatttgggtgaaaatgtttattgaaagtttcaaagttgaaagtccaaatgtcaagtacacagagaataccattcactctgtttacaactatgaaactactcaacttgttcatgaaaacaagaatggtgcttatcaatggactgttaaaccaaaaactgtcaaatatgagttcaatacagacactaatgttcctaaacttggggttatgcttgtgggatggggaggaaataatggctccactctcactggtggtttgattgctaaccgggaaggaatctcttgggctactaaagacaaagttcaacaagccaattattttgggtctcttactcaagcttcaaccattagagttgggtcctttaatggggaagaaatttatgctccatttaagagcttacttcccatggtgaatcctgatgatattgtgttgggaggatgggacataagtgacatgaacttggcagatgccatggcaagggccaaggtttttgacatagatttgcagaaacaattgagaccatacatggaatcacttgttcctcttcctggaatttatgatcctgatttcattgctgcaaatcaaggatctcgtgctaacaatattatcaaaggaaccaagaaagaacaagttcaagaaattattaaacacatgagggagtttaaggaggcaaacaaggtggacaaagttgtagttctctggactgccaatacagagagatacagcaatgttattgttgggttgaatgatacaactgaaaaccttttggcttctttggagaggaatgaatctgagatttctccttcaactttgtatgctttggcttgtatttatgaaaatattcctttcattaatggaagccctcagaacacctttgttccaggactgattgatttggccatcaagcacaatagcttgattggaggagatgacttcaagagtggtcaaaccaagatgaaatctgtcttggttgatttccttgtgggggctggtatcaagccaacatcgattgtgagctacaaccatttgggaaacaatgacggaatgaaccttagcgcaccccaaactttcagatccaaagagatctcaaagagtaacgtcgttgacgacatggtgtcaagcaacggtatcctctatgaaccaggggagcatcctgaccatgtcattgtgatcaagtatgtgccatatgttggagacagcaagagggcaatggatgaatacacctcagagatatttatgggtggaaagagtactattgttatgcacaacacatgtgaagattctcttttagctgctcctatcatcttggacttggtcctacttgctgagctcaccactcgtatccaactcaaatctgaggctgaggataagtttcactctttccatccggttgctaccatcctcagctaccttaccaaggccccacttgttccaccaggtacaccagtggtgaatgcactctccaagcagagggcaatgctggagaacataatgagggcatgtgttggtctggcccctgagaacaacatgatcttagagtacaaatgatagttatttgatgtggggacctagtgatgagcctgtctatatagttaaataatatagtagatagattcaggtttgtaccgcctttgttatctggtttttaatgaaagcgtgattattgtgttctattttgttctattttatttgtgcaagtattatatctttgaaccggaattgtggacttaaaagtgttgaagtggggtgttatcgggtcatttgtattgtcaaactcttgaattaagacaaagtaatttgcctgtaagtttaaaaaaaaaaaaaa

SEQ ID NO: 522 - DNA, 1922 bp, Primula
ccaccacacaaacaccaatttgcccatcccatgattaatcatttttttcataatttaaaaaataatgtttatagagagctttaaggtagagagcccaaacgttaagtacacggaggatgagatacactccgtttataactatgaaaccactgagctcgttcacgagagccgtaacggctcttatcaatggatcgttaagcccaaatccataggctaccagtttaagacccttacacgtgtccctaaactaggggttatgctagttggatggggtggaaacaatggctcaaccctcacggcgggtgtaatcgccaatcgggaggggatttcctgggctacgaaagataaggtccaacaggcaaactattggggctcactcacacaggcatctgccatccgagttgggtctttcaatggagaagagatttatgctcctttcaagagccttctccccatggtgaatcctgacgacgtggttttcggagggtgggatataagtgacatgaacttggccgattcaatggccagggcaagagtcctagacattgatctccaaaagcagctaaggccttatatggaacatatggtcccactccctggtatttttaatcctgatttcatagccgctaaccaaggctcacgtgccaaccacgtcatcaaaggtaccaagcaagaacaacttcagcaagtcatcaaagacattagggagttcaaggagaaaagcaaggtggataaggtggtggtgttatggactgctaacacagaaagatacagcaatgtgattgtggggttaaatgatacgatggagaatctaatggcttctgtggacaagaatgaggccgagatatcgccttctactctgtatgccattgcttgtgtgcttgaaaatgtccctttcatcaatggaagcccacagaacacctttgtcccaggactgattgaattggctatccagaggaacactttgattggaggagacgacttcaagagtggccagactaaaatcaaatctgttctggttgactttcttgttggagccggtattaagccaacttcaattgtgagctacaatcacttgggtaacaacgacggaatgaatttatctgcccctcaaaccttccgctccaaagagatttctaaaagcaatgttgtcgatgacatggtgtctagcaatgctattctgtatgaacccggcgagcacccagaccatgttgttgtcattaagtatgtgccttatgtgggagatagcaagagggctatggacgagtacacatcggagatatttatgggtgggacgaacactatagtgatgcacaatacttgcgaggactcgttgttagctgccccaattatcttggatttggttcttcttgctgagctcagcactcggattcaactcaaagcggaaggagagggtaaattccactctttccaccctgtgagtgtcatcctcagctacctcaccaaagctccacttgtaccaccgggaacaccagtggtgaacgcgctttcaaagcaaagggcaatgcttgagaacatattgagggcttgtgtcggtttatctcccgaaaacaacatgattttggaatacaagtgaactattgtgcaagaagggaaagtctattgcaatgcaactgcaaataatagtgtccgattctcttgtatttgtaatatttatgggcttagagttctttcattgtcgtgtttgttttgtcgacgcttttgtgctttgggtgtttcggatgtagtgttatgttgcgagctccaacacatttgagagcaagtgataaaactcttaatgtcctggaaatatatatgcaagtacatttggacttgtaagttgtgtttcagcttcttttgctatgggttgttgtttggccgttagcaaaccctatcataaaggaaaatttacaattcgtgta

SEQ ID NO: 523 - DNA, 1751 bp, Amorphophallus
agaggggaaggagaggagggttgcgcgcagagagagagagagaggggagagttctcagatcttcttctccttcggcttctcctcttattaccgcttcctgcaacctttcgtattctcgatcgatcgacagaggaatcgagaaggaaggatgttcatcgagaagttcagggtggagagccccaacgtgaagtatggggcgcacgagatcgagtcggtgtacagctacgagacgacggagttggtgcacgagctcagggacggcagctaccagtgggtggtgaagcccaagtccgtgcggtaccagttcaagacggacacccgcgtccccaagctcggtgtgatgcttgttggatggggagggaacaacggggccaccctcactgctggtgtcattgctaatcgagaggggatctcatgggtgaccaaggacaagatccagcaggccaactattttggatccctgacccaagcttcaaccattcgcgtgggatccttcaatggcgaggagatctacgcccccttcaagagcctcctccccatggtgaacccagatgacatagtgtttggagggtgggacatcagcaacatgaacctggcggacgccatggccagggccaaggtgctcgatatcgacctacagaagcaattgcgtccctacatggaggccatggtgccgctgccgggcatctacgaccccgacttcatcgccgctaaccagggctctcgcgccaacaacgtcgtcaagggctccaagaaagagcaggtccagcaggtcatcaaggacatcagggagttcaaggagagagagaaggtggaccaggtggtggtactgtggaccgccaacaccgaacgctacagcaacgttgtggtcggcctcaacgacaccacggataacctcctggcggcgctggaccgggacgaggcggagatatccccctcgacgctgtacgccctggcctgcgtcctcgagaacgtccccttcatcaatggcagtccccagaacaccttcgtccccgggctgattgatctggctatcaagaagaacagcatgattggaggagacgatttcaaaagcgggcagaccaagatgaagtccgtccttgtggatttccttgttggagcagggatcaagccgacatccatagtgagctacaaccatctcggcaacaacgacggcatgaacctgtcggcgccacagacgttcaggtcgaaggagatctccaagagtaacgtcgtcgatgacatggtatcgagcaacggcatcctgtacgagcccggcgagcaccccgaccatgtcatcgtcatcaagtatgtgccgtacgttggcgacagtaagagggcgatggacgagtacacctcagagatcttcatgggtggtaagagcacaatcgtactgcacaacacctgcgaggactcgctgcttgccgcgcccatcatccttgacctcgttctgttggccgagctgagcaccaggatacagctcaaggctgaaggagagggcaagttccactccttccaccctgtggccgccattctgagctacctcaccaaggctccattggtcccaccgggcacaccagtggtgaatgctctgtccaagcagagggccatgctggagaacatcttaagggcctgcatcggcctggccccggagaacaacatgatcttggaatacaaatgaactgcattccaggtggacgacaagagaaacagaaccatgaaagaagaataacctttcccccggttttccc

SEQ ID NO: 524 - DNA, 1800 bp, Arabidopsis lyrata
ctctctctctcaagcatcaattatttctcaaagttttccttaggcaaaaatgttcatcgaaagcttcaaggttgaatctccgaacgtgaagtacaccgagaatgagatccattcagtgtacgactaccaaaccactgagcttgttcatgagaacaaaaacggtgcgtttcaatggactgtgaagccaaaaaccgtgaaatatgagttcaagaccgacactcatgttccaaaacttggagtaatgctcgttggttggggaggcaacaatggttctacgcttaccgctggtgtaatcgccaatcgtgagggaatatcttgggctacgaaggagaaagtgcagcaagctaattatttcgggtcattaacccaagcatcctctattcgggtcgggtcttttaatggtgaagaaatctatgcacctttcaaaagtcttctccccatggtgaatcctgaagaaattgtgtttggaggatgggacataagtgacatgaacttagcagacgcaatggcacgagccaaggtcctagacatcgacctccaaaagcagctgcgtccgctcatggaacacatggtcccactccctggaatcttcgacccagattttatcgcagctaaccaggggtcgcgtgctaaccacgtgatcaaaggcaccaagaaacaacaactcgagcaagtcatcaaggacatcagggagttcaaagagaaaaacaaggtggataaagtggtggtactgtggacggcgaacacagaaagatacagcaatgtggtggttggtcttaacgacacgacggagaatctaatgtcatctttggaaaaggatgaggctgagatttctccttctacactttacgccattgcttgtgttcttgagaacgttcctttcatcaatggaagtccacaaaacacttttgtccctgggcttattgaattggccatcgagagaaactgcttgatcggtggtgatgacttcaagagtggtcagaccaagatgaagtctgtcctcgtcgatttccttgttggtgccggaatcaaaccgacgtcgattgtgagttacaaccaccttgggaacaacgacggcatgaacttgtcagcgccgcaaacattccggtcaaaggagatatcgaagagcaatgtcgtggacgatatggttggtagcaacggaattttgtacgagcctggtgaacaccctgaccacgttgtggtcattaagtatgtgccatatgtaggagatagcaagagagcaatggacgagtacacatcagagatattcatgggagggaagaacacgattgtgatgcacaacacttgtgaagactctctcttggctgctccaattattttggaccttgttcttcttgctgagctcactactcggatccagttcatggccgaaaccgagggaaagttccattctttccatccggtggctactctcctaagttacctctcaaaggcaccactggtccctcctggtacgccagttgtgaatgctttgtcgaaacagcgtgcaatgcttgagaacatactcagagcttgtgttggacttgctcctgagaacaacatgattctcgagtacaagtgatcaaagagacgagaccaatcaatcgatcaagactcgctttcttagcttttcgctttttatgtttatttaataattacatttctaaaatgtaagtgttccttttcttattttttctttctcatttacaaatgtcatctatctggtttcgttaccttctccagccaaatatgtaatggtgtctcgcgctgaattggaattgtcttctatctcatttcaaa

SEQ ID NO: 525 - DNA, 1744 bp, Beet
ttctaattcataactcataagagagagaaagttaagaaaaaggcaaagaggttcccaaattagagctttctagttcttctagcactctcattccctcactcttcttcttcttcatctttctctctctctgtatttttctcccagaaaacaaaaataaaacagatcctaaattcacggttttttgaattgaaaatttttgtaagaaaaatctaaaaatgttcatcgataatttcaaggtagaaagcccaaatgttacctacactgagaatgaaattcattcggtttataattatgaaaccactgaattggttcacgaaaatcgcaaaggttgcggttatcagtggatcgtcaaacctaaatctgtcaaatatgagtttaaaactgacacccacgtccctaaacttggggtgatgttggttggatggggtggcaacaacggttgtaccctcaccggtggtgtcatcgctaaccgcgagggaatttcatgggcaacaaaggacaagattcagcaagccaattattttggatccctaactcaggcatcctcaattcgtgttggttctttcaatggagaagaaatttatgctcctttcaagagcctccttcctatggtgaacccagatgacatagtgtttgggggttgggacataagtgacatgaatttggcagatgcgatgaccagggcaaaggtcttggacattgatctgcaaaagcaattgaggccctacatggagcacatgattcccctccctggaatttatgatcctgattttattgctgccaaccaagattctcgtgctaataacatcattaagggcactaaaaaggagcaagttgagcaagtcattaaggacatcagggagttcaaggagaagaacaaagtggacaaagtagtggtgctttggacagcaaacacagagaggtacagcaatgtggtggaagggctgaatggcaccacagagaacctgttggcatccgttgaaaggaacgagtccgagatctcaccatcgactttgtttgcacttgcttgtgtccttgaaaacatacctttcatcaatggtagtcctcagaacacctttgtccctggactcatagagctcgccactaagaataacagtttaatcggaggagatgacttcaagagtggtcagactaagatgaaatccgtgcttgtggatttccttgttggggctggtattaagccgacatcaattgtgagctacaaccacttgggaaacaatgacgggatgaacctttcagcacctcagaccttcaggtctaaagagatatcaaagagtaatgtggttgatgacatggttgctagtaatggtatcttgtatgagcctggtgaacaccctgatcatgttgttgtcattaagtatgttccatatgtgggagacagcaagagagccatggatgagtacacatccgagatattcatgggcggaaagaacaccattgtcctgcacaacacctgtgaagactctctcttggctgcaccgattatcctcgatttggtcctccttgctgagcttagcacccgcattgaattcaaggctgaaacagaggacaagttccactccttccatccagttgctaccatactcagttaccttactaaagcacctcttgttccaccgggcactcctgtggtgaacgcgctctcgaaacagagggcaatgctggagaacattatgagggcatgcgtcggtttagctcctgagaacaacatgattctcgagta

SEQ ID NO: 526 - DNA, 1901 bp, Chelidonium
gttagtagagagaagaagaaagactagagagagagagagaaatattctagtgagagaaagaggaagaagtgagagagagtttgttttgctcactctgccctcttctttctttgatttgagtgtgttcttgtttggttctctcatttatttattttgattttcattttgatttttgtgaaaatgtttattgagaatttcaaggttgagagcccaaatgttaagtactcagagaatgaggttgaatctgtttacttctatgaaactactgaacttgttcatgagaacaagaatggtacctatcaatggactgtcaagcccaagactgtcaaatatgagttcaagacagacaccaaggtccctaaactaggggttatgcttgttggatggggaggaaacaatggatcaacccttaccggtggtattattgcaaaccgggaaggaatctcttgggctacaaaagacaaagttcaacaagccaactattttggctcactgacccaggcttcaacaatcagagttggatcttttaatggagaagagatttatgctccatttaagagcttacttcccatggtgaatcctgatgatattgtgttgggaggttgggacataagtgacatgaacctagcagattccatgtctagggctagggtatttgacatagatttgcagaagcaattgaggccatacatggaatccatggttccactccctggggtttatgaccctgacttcattgctgcaaatcaagggtctagggctaacaatgttatcaaaggaaccaagaaagaacaacttcaacaaatcatcaaggatataagggagtttaaggagactaacaaggtggataaggtggtggttctttggactgcaaacactgagagatacagcaatgttattgtgggtcttaatgataccacagagaacctcttagcttctttggagaagaatgagtctgaaatttctccttcaactttgtatgctttggcttgtatctatgaaaatgttcctttcatcaatggaagccctcagaacacctttgttccaggggtgattgatttggccatcaagcacaacactttgattggtggagatgacttcaagagtggtcagaccaagatgaaatctgtcttggtagattttcttgtgggagctggaatcaagccaacttcaattgtgagttacaatcatttaggaaacaacgatgggatgaatctgtcagcaccccaaacattccgttccaaagagatctcaaagagtaacgtcgtggacgacatggtctctagcaacggtatcctctatgaacctggcgagcaccctgaccatgtcattgtcattaagtatgtgccgtacgtgggagatagcaagagagctatggatgagtacacctcggagatattcatgggtggaaagagcacaattgtcatgcacaacacgtgtgaagattccttattggctgctcccattatcttggacctggtactccttgctgagcttagcacccgtatccaactcaaatctgaggcagaggagaaataccattccttccatccagttgcgaccatccttagctacctcaccaaggccccacttgttccaccaggtacaccagtggtgaatgcattgtccaagcagagggcaatgcttgagaacattatgagggcatgtgttggattggctccagagaacaacatgatcttggagtacaaatgaacatctcatcaaattgaagcagtgagagagagactgaagatattttaatcttgattgcaatttgaggaccccatccccaccacctcttcctcctttgtgttttcttttaatgagttggtaaatatataaatatctatatatttaagatgtagtttgttataaaggagcttgtcaatttacaactcctt

SEQ ID NO: 527 - DNA, 2187 bp, Eucalyptus
aagcagtggtatcaacgcagagtggtggcaacggccgggggtatcaccaccgccaacgattgcccagagaagcagagcaatcccctggccttgagcgagagccagcgagcgttctcgtttgttcccctcctgccccgagccgagccgacgtgtttctctcctcgtctcttcctctttcccccgcgcgcgagacgctagaattcgcagcaggccaggccgtgatgtttatcgagagcttcaaggtcgacagccccaacgtgacgtacggcgacgccgagattcactccgtgtacgactaccagaccaccgagctcgtccacgagaaccgcaatggggcgtaccagtggaccgtcaagcccaagtccgtcaagtacgagttcaagaccgacacccgcgtccccaagctcggggtgatgctggtcggctggggcggaaacaacggctcgaccctcaccggcggcgtcattgcgaaccgagaaggaatctcctgggcaaccaaggacaacgtccagcaggccaactatttcggctctctgacccaggcgtccaccatccgtgttgggtcctacaatggagaagaaatccatgctcctttcaagagcctcctccccatggtcaacccagatgatatcgtaatcgggggatgggacatcagtaaaatgaacttggctgatgctatggccagggccagggtgtttgacatcgatcttcagaagcagctccggccgtacatggagcacatggtcccgctccctgggatctatgaccccgacttcatcgcagccaaccaggaggctcgcgctaacaatgtgatcaagggctccaagaaggagcaggtccagcaaatcatcaaggacatgagggactttaaggagaaaaataaggtggacaaggtggtggtgctgtggactgccaacacggagaggtacagcaatgtggtggtgggtctgaacgacacaatggagaacttgatgaattccatggagaagaacgagtccgagatttcgccttccactttgtatgcaattgcttgtgtgctcgagaacatccccttcatcaatggaagcccgcaaaacactttcgttcctggacttattgacttggccatccagaggaacgttttgattggaggagatgacttcaagagtggccaaaccaagatgaaatctgttctcgtcgatttcctggtcggggctgggatcaagccaacctcaatcgtgagctacaaccatcttggcaacaacgatgggatgaatctctcggcccctcagacattccggtccaaggagatctcgaagagcaatgtcgtggatgacatggtcgccagcaacgccatcctttacgagcctggtgagcacccggaccacgtcgtggtcatcaagtatgtgccatatgttggggacagcaagcgggcgatggatgagtacacatcggagatattcatgggaggcaagagcaccatcgtcctccacaacacgtgtgaggactccctcttggccgccccgatcatcctcgatttggtcctcctggctgagctcagcactcggatccagctcaaggccgaaggagagggcaaattccactcgttccacccagttgcaaccatcctcagctacctcaccaaggcccctctcgtcccgcccggcactcccgtggtgaatgcgctggcgaagcagagggcgatgctcgagaacataatgagggcctgtgtgggcttggctccggagaacaacatgatcttggagtacaagtgacgagctagttcagaaccccgcccctcgctcgctctctggttccgaaacaacatgctctttctttcccctgcgccatactccgtggtgattgtgtaaagccgtgaagattgtctcgtgaagattgttaagccgtgaagattgtcatgtgaagattgtctctagtcgatgtcagcaaaaatcgtctcctcactccggtgattgttccgtttgttttatgtctatattacatttcaaggtaaacgctgtacgaaggtgctcagcgagcgttctcagcgagcgtagggccgctctgtcatgctccttccgtggatgaagcaccctttttgtggtgcaaaatcatagtaaataaatcttccgattccgtgcattcgcttttccatagaatctttttttcattttcatatggatgaagatcattagaatttgcttctcg

SEQ ID NO: 528 - DNA, 1884 bp, Arabidopsis
attcagaagcactcgagcaaacataatatatctctctcttcctctctctctcaagcatcaattaattctcaaagtcttccttaggcaaaaatgttcatcgaaagcttcaaggttgaatctccgaacgtgaagtacaccgagaatgagatccactcagtgtacgactaccaaaccactgagcttgttcatgagaacaaaaacggtgcttttcaatggactgtgaagccaaagactgtgaagtatgagtttaagaccgacactcatgttcccaaacttggagtaatgctcgttggttggggaggcaacaatggttctacacttaccgctggtgttatcgccaatcgtgagggaatatcttgggctacaaaggagaaagtgcaacaagctaattatttcgggtcattaacccaagcatcttctattcgggtcgggtcatttaatggtgaagaaatctatgctcctttcaaaagtcttctccccatggtgaatccggaagaaattgtgtttggaggatgggacataagtgacatgaacttagcagacgcaatggcacgagccaaggtcctagacatcgaccttcaaaagcagatgcgtccgttcatggaacacatggttccactccccggaatcttcgacccagatttcatcgcagctaaccaagggtcacgtgctaaccacgtgatcaaaggcaccaagaaacaacaactcgaacaagtcatcaaggacatcagggagttcaaagagaaaaacaaagtggataaagtggtggtactgtggacggcaaacacagaaagatacagcaatgtggtggttggtcttaacgacacgacggagaatctcatgtcatctttggacaaggatgaggctgagatttctccttctacactttacgccattgcttgtgttcttgagaacgttccttttatcaatggaagtccacaaaacacttttgtccctgggcttattgaattagccataaagagaaactgcttgatcggtggtgatgacttcaagagtggtcagaccaagatgaagtctgtcctcgtcgatttccttgttggcgccggaatcaaaccgacgtcgattgtcagttacaaccatcttgggaacaacgacggcatgaacttgtcagcacctcaaacattccggtcaaaggagatatcgaagagcaatgtcgtggacgatatggttggtagcaacggaattttgtacgagcctggtgaacaccctgaccacgttgtggtcattaagtatgtgccatgtgtaggagacagcaagagagcaatggatgaatacacatcagagatattcatgggagggaagaacacgattgtgatgcacaacacttgtgaagactctctcttggctgctccaattattttggaccttgttcttcttgctgagctcactactcggatccagttcatgagtgaaaacgagggaaagtttcattctttccatccggtggctactctcctaagttacctctcaaaggcaccactggttcctcctggcacgccagttgttaatgctttgtcgaaacagcgtgcaatgcttgagaacgtactcagagcttgtgttggacttgctcctgagaacaacatgattctcgagtacaagtgatcaaagagaccaattcaagaccccctttcttagctatgttgctttctatgtttaataaataattacatttctaaaatgtaagtgttcttttctttgtctttctctcatttacaaatgtcatctatgtggtttcgttatcttccccagccaaatatgtaatggtatctcgcgctgaattgggattgtctttcatctcatttcaaactataatatatatttgggtcatctagttattaaaactgaagttgcttttttaatata

SEQ ID NO: 529 - DNA, 2615 bp, B. rapa
cttgtcttcacgtatatagacagacccaagcttccaacgtgtctctcacattctagtttcatccacgcgtgtgaaccaagcaaacacgtgtggtttagtggctctcagtctctcttgggcttagagtagtgggctcgctcgtctcactgaaccaaccatctcctctcagaccatcacaaacattacgccacgtgtccctccttctctatatatcctcgctcttgttcgtcgattcaagatcacaaaaccaaaccaaacactaaagagagaagatgttcatcgagagctttaaggtagagagcccgaacgtgaagtacacagagaatgagatccattctgtgtacgattacgaaaccacagaggtcgtccacgagaaccgtaacggttcttatcaatggatcgtcaagcccaaaaccgtccaatacgatttcaaaacagacactcgtgtccccaagctaggggttatgcttgttggttggggaggaaacaatggatcgactctaaccgctggtgtgatcgctaacaaagaagggatctcgtgggcgactaaagacggagtgcaacaagcgaactactttggctcactcactcaagcgtcttcgattcgtgtcggatcttacaacggcgaagagatctacgctcctttcaagagtcttctcccaatggtgaatccagacgacgttgtgtttggtggttgggacattagcgacatgaacttagcagacgctatggctagagctagagtcctcgacattgatctccaaaaacagcttaggccttacatggagcacatggtcccgctccctggtatctacgaccctgacttcatcgctgcgaatcaagggtcacgtgctaatagcgtgatcgaaggtaccaagaaagaacaagttgatcacatcatcaaggacatgagggagtttaaggagaagaacaaagtggataaggtggttgtgttatggacagccaacacagagcgttacagcgatgtggttgtagggcttaatgatacgatggagaatctattggcttctgttgagaagagcgagtctgagatctcgccttctacgctttatgctattgcttgtgttcttgaaggcgttcctttcatcaacgggagtcctcagaatacttttgtcccggggcttatagagctggctatatcgaggaactgcttgattggtggggacgacttcaagagtggtcagactaaaatgaaatctgttttggttgattttcttgttggagctggcatcaagcctacttcgattgtgagctataatcacttgggaaacaacgatgggatgaacctctcagctccgcagactttccggtccaaggagatttcaaagagtaatgttgttgatgacatggtggctagtaatggcatcctctttgagcctggtgaacatcctgaccatgtcgttgtcatcaagtatgtaccgtatgttgcggatagtaagagagccatggatgagtacacctcggagatattcatgggagggaagaatacaattgttatgcataacacttgtgaggattctctgttggctgctccaatcatcttggatcttgttcttctcgctgaactcagcaccagaatccaattcaaagccaaaggagaggggaagtatcactctttccacccagtagcaaccatactcagttacctcacaaaggcacctctagtaccgcctggaacgccggtggttaacgctctatcgaagcagagggctatgctggagaacattcttagggcctgcgttgggcttgccccagagaacaacatgatcttggagtacaagtgagaggacagggaggacgaagaagagcaaaaaggatctaaaactttagcttaagcttttggatcaaatgtgtaatagacttaaagagtaactatctttgtgttaaaccaaactttatttattttatttatatcatgaatctcttcatcactcaagagagacattaatacagaacacacaaggccaagagaatcacagaaaaagaaaacacatatagcagcgagtgagactgtgagatcaggacgaagtacctgcagaagaaactatcgtgaactcgccttcgcagaccaaggaggcacccacataagctttaccttccatcttagcaagcccgaagcgtttctggaagctgaggatagtcatcctcatgaccagtgtgtctcctgcaaccactggtttgtggaatttcactttatcaataccgccaacgaagaagttatcttgagaccctcctacttccggcagcattactatgcctcccacttgtgccattgcctaaagacgcacacaaactcaactttttagttaagctactcataaaacgaccattttaattttggaccgagctagacatgatcattaggcccaatttacatcctaaaatcatataaagatgtcacactaacccaaaggtctaaaactaacgtgagactttaagcattgttgttacctcaatcatgagaacaccaggcatgatgggtcgatcagggaaatgaccggggaagaagttgtcattgatagtgacgttcttaatagctacagctgaaacaccaggcgtgtactctatcactctatccaccagcagtaacggaa

SEQ ID NO: 530 - DNA, 1917 bp, B. rapa
actaaatgtccatttgtctataaaagcgagtttggtcctcaaatcgcaaagcattcagaagcatctccttcagaagcatcaaaaacagttctcaaagtttccttcagaaaaagattaggcaaaaatgttcattgaaagcttcaaggttgaatctccaaaagtgaagtacacggagaatgagattcattcagtgtacgactaccaaaccactgagcttgttcatgagagcaaaaacggcgcgtatcaatggaccgtgaagccaaaaaccgtgaaatatgagtttaagaccgacactcatgttcctaaacttggagtgatgctcgttggttggggaggaaacaatggttctactcttaccgctggtgttatcgccaatcgcgagggaatatcctgggctacgaaggagaaagtgcaacaagctaattatttcgggtcattaacccaagcatcctctatccgggtaggatcatttaatggggaagaaatctatgctcccttcaaaagtcttctccccatggttaatccggaagaaatagtgtttgggggatgggacataagcgatatgaacttagcagacgctatgggacgagccaaggtcctagacatcgacctccaaaagcagctgcgtccgttcatggaacacatggtccccctccctggaatctacgacccagatttcatcgcagctaaccagggatcccgtgccaaccacttgatcaaaggcaccaagaaagaacagctagaacaagtcatcaaggacatcagggatttcaaagagaaaaacaaagtggacaaggtggtggtgctatggacggccaacacagaaagatacagcaatgtggtggctggtcttaacgacacgacggagaatctcatgtcatctttggacaagaatgaggctgagatttctccttctacactctacgccattgcttgtgttcttgagaacgttcctttcatcaatggaagcccacaaaacacttttgtccccgggcttattgaattagcaatcaagagaaacagcttgatcggtggtgatgacttcaagagtggtcagaccaagatgaaatctgtcctcgtcgatttccttgtcggcgctggaatcaaaccaacctcgatagtgagctacaatcaccttggaaacaacgatggcatgaatttgtcggcgccgcagacattccggtctaaggagatttctaagagcaatgtggtcgacgacatggttgctagcaatggtattttattcgattccggtgaacaccctgaccatgttgtcgtcattaagtatgtgccatatgttggagacagcaagagagccatggacgagtacacgtcagagattttcatgggagggaagaacacaattgtgatgcacaacacttgtgaagactctctcttggctgctcccattattttggaccttgttcttctcgccgagctcaccaccaggatcgagctcaaggccgacaatgagggaaagttccattctttccatccagtggctactcttctgagttacctctccaaggcaccattggtcccacctggcacgccagttgtgaacgctttgtcgaagcagcgtgcaatgcttgagaacatactcagagcttgtgttggacttgctccagagaacaatatgattctcgagtacaagtgaagaagagatcagtcaggagatccgcttcatttagctttgcttcattttatgttttcatgaataagtacctttttataagggttgacttcttatttaagccttatattatatattgccgagccaaatattggtgtctcgtgctgaattaaaagtcgttaacaaacgtgaggtctgagatccagatttgtatcgtttttaaataatatttttctgtttcatttcagaacataactaaaagccaaaactattctctctttttt

SEQ ID NO: 531 - DNA, 1913 bp, Millet
cggctataaatcccccgccccgggcagccaaccccgatcacacccacccgagagcagcgcagccgcctcctccctcctctcgcccgcgctacttactcttcgcattccattccaggagagcagcgaggcggggaagtagtggtcaatcgagaggggcggagaggagaggcaagatgttcatcgagagcttccgcgtggagagcccgaacgtgcggtacggcccgtcggagatcgagtcggagtaccggtacgacacgacggagctggtgcacgagggcaaggacggcgcctcccgatgggtcgtccgccccaagtccgtcaagtacaacttccggaccagcaccgccgtccccaagctcggggtgatgctcgtggggtggggcggcaacaacggctccacgctcacggctggggtcatcgccaacagggaggggatatcatgggcgacaaaggacaaggtgcagcaagccaactacttcggctctctcacccaggcctcaaccatcagggtcggcagttacaacggggaggagatctacgcgccgttcaagagcctcctgcccatggtgaaccctgatgacattgtgttcggaggatgggacatcagcaacatgaacctggccgattccatgaccagggcgaaggtgctggacattgacctgcagaagcagctcaggccttacatggagtccatggtgccacttccgggcatctatgatccggacttcattgcagctaaccagggttctcgcgccaacaatgtcatcaagggcaccaagaaagagcaggttgaccagatcatcaaggacatcagggagttcaaggagaagaacaaggtggacaaggtagttgtgctgtggactgcaaacactgaaaggtacagcaatgtatgtgctggactcaatgacacagtggagaacctcctggcatctgtagacaagaacgaggcagaaatctcaccatctacattgtatgccattgcctgtgtcatggagggtgtaccgttcatcaatggaagcccccagaacacctttgtgcctggcctgattgacctcgctatcaagaacaactgcttgattggtggtgatgatttcaagagtggacagaccaagatgaagtctgtcttggttgatttccttgttggtgctggaataaagcccacctcaattgtgagctacaaccacttgggaaacaacgatggcatgaacctgtcggcccctcaaacgttcagatccaaggagatctccaagagcaatgtggtggatgacatggtctcaagcaacgccattctttatgagcccggcgagcatccagatcacgttgtcgtgatcaagtatgtgccctacgtgggggacagcaagagagccatggatgagtacacctctgagattttcatgggcggcaagaacaccatcgtgctgcacaacacttgcgaggactcgctcctcgctgcaccgatcattcttgatctggtcctcctggctgagctcagcaccaggatccagctgaaagccgagggagaggagaagttccactccttccacccagtggccaccatcctgagctacctcaccaaggcgccactggttcctcccggcacaccggtggtgaatgctttggcgaagcagagggcgatgctggagaacatcatgagggcctgcgtcgggcttgcccccgagaacaacatgattctggaatacaaatgagcgtcgtgcttatgtaggagctgctggaagcctggaagcagggaacaagaaagacgagactaggtgtggtgctgtgtgtgtcgtctcgtgtttttttagtttttcccggtcattgttgtacaattctgtttgggttcgtcaggctcgtaactatcagggctctgctattagtggcacgtagcctgtaattgtatcgtatggtatggt

SEQ ID NO: 532 - DNA, 1931 bp, Phalaenopsis
agaggtaaggtcacccttctcttcgcttctaacctcttttccatcaccttcttcggaactttagagagagagagaaacaagggcgaaaatgttcgtcgaaagcttcaaggtcgagagccctaatgtgaagtatggagagcaagagatccactccatttacaactatgaaaccacggaattagtgcacgagagccggaatggatcatatgcctggatcgtgaagcctaagaccgtccaatacgagttcaagaccgatacccttgttcccaagcttggtgtgatgcttgtgggttggggagggaacaatggatccaccctcactgctgcggttattgctaatagagaggggatctcatgggccacgaaggataatgttcagcaggccaactattttgggtcactcacccaggcctccaccattaggattggctcttacaacggggaggagatttatgctcctttcaagagcttgcttcctatggtgaacccagatgaaattgtgtttggaggatgggacataagcaacctaaacctagcagattcgatgactagagccagggtcttggacattgatcttcagaagcaacttaggccctacatggaatccatggtccctcttcctggtatctacgatccagatttcattgccgccaatcaagattcccgtgccaacaatgtcatcaaaggaaccaagagtgagcaagtccaacaagttattaaggatattagggagttcaaggataagaacaatgtcgataaagtcgtcgttctttggactgcaaacactgagaggtacagcgatgtgatggttggcctcaatgacaccactgagaatctccttgcatcattggaaagaaatgagactgagatctccccatccaccttgtatgctattgcctgcgtcatggagaacattccattcatcaatggaagcccacaaaacaccttcgtgcctggacttattgattttgccattcagaggaacagtcttattggaggagatgacttcaagagcgggcaaacaaagatgaaatccgtcctcgttgattttctcgtcggtgcagggatcaagccaacctccattgttagctacaaccatcttggtaacaatgatggcatgaacctctctgcaccacaaacgtttcgttcaaaagagatctcgaagagcaatgtcgtcgatgatatggttacgagcaacggaatcctctatcaaccaggggagcatcccgaccatgtcgttgtcattaagtatgtgccttatgttggggatagcaaaagggcgatggacgagtatacctccgagatcttcatgggtgggaaaaacacgatcgttcttcacaacacctgcgaggactcgctacttgctgcacctataattcttgatttggtgctcctggctgagcttagctccagaattcagttcaaggctgagggggagggaaagttccattccttccatcctgtggcaaccatactgagctacctgactaaagctcctcttgttccacccggcacaccggtggtgaacgccctctcgaaacagagggctatgctggagaacatactgagggcttgcattggcctggctccagaaaacaatatgattctggagtacaagtgagacttctctgaaaagggttggagaactgaaggctatttgagtggcggaactataagattacagattcggttctctcccccatttttcttcttccaattattatataatatgtaattgttgttgactctcggtgattatggtaaatcaacttgtgttcaaatcttgtgattctgtcttttcaatttaagtgcggaaacctgtgcgagccgctagtagctctcttataacaataatgcgtgacttctctactaatattaaatccttttattatttatagcttcagcgccaaaaacaaattggtaaatttacg

SEQ ID NO: 533 - DNA, 1759 bp, Silene
gatccttgttttacggctgtaaattaaagagaatcaaactaataataaatcaaacaaaaatgtttattgaaaactttaaggttgagagccctaatgttgagtacagtgacggtgaaatccgttcagtttatgattaccaaactactgagttagttcatgaaaaccgtaagggttccggttatcaatggatcgtcaagcctaaatccgttaagtatcagtttaagactgatactcgtgtccccaaacttggggtgatgctagtaggctggggtggcaacaacgggtgtaccttaaccggtggtgtgatcgcgaaccgtgagggaatatcatgggcaacaaaggacaagattcagcaagccaactattttgggtcacttactcaagcttcctcaattcgtgttggttctttcaatggtgaagaaatctatgctccttttaagagcctccttcctatggtgaacccagatgacatagtatttggaggatgggacataagcaatttgaacctagcagatgcaatgaccagggctaaagtcctggacattgatcttcagaagcaattacggccttacatggagcatatggttcctcttcccggtatctatgaccctgatttcattgccgcgaatcaagattctcgtgccaataacatcattaagggcactaagaaagagcaagttgatcaggtcattaaggatatcagggagtttaaggagaagaacaaagtggacaaggtggtggtgttatggacaggaaacacggagaggtacagcaatgtgcaggtcggtctgaatgacaccatggagaactttttggcgtctgtcgagaagaatgagtccgaaatttctccctcgacattgtatgctttggcttgtattcttgaaaatgtgccattcatcaatggaagtcctcagaacactttcgtccccggactcattgatctggccatcaagaataacagcttgattggaggtgacgacttcaagagcggtcaaaccaagatgaagtctgtgctcgttgacttccttgttggagccggtatcaagccaacatcaatagtgagctacaaccacttgggtaacaatgacggtatgaacctttcggcacctcagacttttaggtctaaagagatctctaaaagtaatgtcgttgacgacatggttgcaagcaatggcattctctttgagcctggtgaacaccctgatcatgttgttgtcattaagtatgtcccatatgtgggagatagcaagagagccatggatgagtacacatccgagatcttcatgggtggaaagaacaccatagtgatgcacaacacctgtgaggactctctcttagctgctccaatcatcctcgacttagtcctccttgcggaactcagcactcgaatccagcttaaggccgagaatgaggagaagttccattccttccatcccgttgctaccattctcagttaccttaccaaagcccctcttgttccaccaggcacaccagtggtgaatgcactatccaagcagagggcaatgctggagaacataatgagggcttgtgtcgggttagccccagaaaacaacatgattctcgagtacaagtgatgatcgtaggcgtagccatagcagcagcaaaccccccttgatcctgagcttcggcaataaaacttatgtgacctgaaagctctttctttaggtgttagttgttgttgtattaggcatatcccccatcaatccaactctatcatgcggtttttatgtcttgtttc

SEQ ID NO: 534 - DNA, 2439 bp, Sorghum
cccaaaacctccatccgacggctcgccatcttcttcctatcgctcatttccacagcccacaggccgccgccggccgacgccatcccatttcgcttccttcctctgcctgcggcgcagcaaaagttccgggccttccggcaatcccccgtcgtccggcggctcaaatcgtatcgtatctgacgcggctacgacgtcgctcctcctccgatccggtggggtccgtttctctttcaagtggggccgtgaaaagccagctagtcgcgggccgcctcgtggcagtgaccgtcgaaccctctataaatccccctccccggacaccttctccgatcacacaacccagcagcagcagcagcagcagcagccctccttcaacctcttctctcgctcgcttggcattccattcgagggggaggaaaggcaagatgttcatcgagagcttccgcgtcgagagcccccacgtgcggtacggcccgacggagatcgagtcggagtaccggtacgacacgacggagctggtgcacgagggcaaggacggcgcctcccgctgggtcgtccgccccaagtccgtcaagtacaacttccggaccagcaccgccgtccccaaactcggggtgatgcttgtggggtggggaggcaacaacgggtccacgctgacagctggggtcattgccaacagggaggggatctcatgggcgaccaaggacaaggtgcagcaagccaactacttcggctccctcacccaggcctccaccatcagagttggcagctacaacggggaggagatctatgcgccattcaagagcctcctgcccatggtgaacccagacgaccttgtgttcggaggctgggacatcagcaacatgaacctggctgattccatgaccagggccaaggtgctggacattgacctgcagaagcagctcaggccctacatggagtccatggtgccacttcccggcatctatgacccagacttcatcgccgctaaccagggctctcgcgccaacaatgtcatcaagggtaccaagaaagaacaggtggagcagatcatcaaggatatcagggaatttaaggagaagaacaaagtggacaagatagttgtgctgtggactgcaaacactgaaaggtacagcaatgtatgcactggtctcaacgacacaatggagaatctgctggcgtctgtggacaagaacgaggcagagatctcgccatcaacactatatgccattgcctgtgtcatggagggggtgccgttcattaatgggagccctcagaacacctttgtgccagggctgattgatcttgctattaagaacaactgcttgattggtggtgacgacttcaagagtggacagaccaagatgaaatctgtcttggttgatttccttgttggtgctggaataaagcccacctcaattgtgagctacaaccaccttggaaacaacgatggcatgaacctgtctgcccctcaaacattcagatccaaggagatctccaagagcaatgtggtggatgacatggtctcaagtaatgctatcctctatgagcctggcgagcatcctgatcatgttgttgtcatcaagtatgtgccgtatgtgggagacagtaagagggctatggacgagtacacctccgagatcttcatgggtggcaagaacaccatcgtgctgcacaacacctgtgaggactcactcctcgccgcacctatcatccttgatctggtgctcctggctgagctcagcaccaggatccagctaaaagctgagggagaggacaagttccactccttccacccggtggccaccatcctgagctacctcaccaaggcacccctggttccccctggcacaccggtggtgaacgctttggcaaagcagagggcgatgctggagaacatcatgagggcctgcgttggcctggccccagagaacaacatgatcctggagtacaagtgagcgaagtggcgtggcctatatgcaggaggctgctggaagggaactagaatggcgagattagctgtgggattgtattggcttctcgtgttttcttttgcgttctttcctggtcattgctgttacgcttgtgtatttgtcggacccgtaactatcagggctctgctattagcggcacgaagcctgtaatagtatcaggtatcgtatgataatttgatggagggtgctagtttccctcggcattcctagtgttcattgcaagtttcctcgacgcctgttcggattttaaatgttatatcactactaaaatggtggagttctcctagtgtttttagttagtaataaaacactaccactagtcaaaacactaagaatttctcattagaaggcatttattagggaaagttcatactaaattttgaatactaaaacactagaagaaccccacatcactagaagaaattataaaatctggttgtgtatgctg

SEQ ID NO: 535 - DNA, 2233 bp, Sugarcane
cccacagtccaacaccggcaaccggccgccggccgacggcctcccatttcgctctgctcctctgctgcctctgcctgcggtccagcaaaagttccggccttccggcaatcccccgtcgctcctcctccgatccggtggggtccatttctttcaagtggggccgtgaagagccagctactcgcgggccgcctcgtggcagtggccgtcgaaccctctataaatcccccgccccgggcacccttccccgatcacacaacacaacccagcagcctctcgctcgctacctcgcttcgcatcccattcgaggagagcggcgagaggggaggaaaggcaagatgttcatcgagagcttccgcgtcgagagcccccacgttcggtatggcccgacggagatcgagtcggagtaccggtacgacacgacggagctggtgcacgagggcaaggacggcgcctcccgctgggtcgtccgccccaagtccgtcaagtacaacttccggaccagcaccgccgtccccaaactcggggtgatgcttgtggggtggggaggcaacaacgggtccacgctgacggctggggtcattgccaacagggaggggatctcatgggcgaccaaggacaaggtgcagcaagcaaactacttcggctccctcacccaggcctccaccatcagagtcggcagctacaacggggaggagatctatgcgccgttcaagagcctccttcccatggtgaacccagacgaccttgtgttcggaggctgggacatcagcaacatgaacctggctgattccatgaccagggccaaggtgctggacattgacctgcagaagcagctcaggccctacatggagtccatggtaccacttcctggtatctatgatccggacttcatcgctgctaaccaaggctctcgtgccaacaatgtcatcaagggcaccaagaaagaacaggtggagcagatcatcaaggatatcagggagtttaaggagaagaacaaagtggacaagatagttgtgctgtggactgcaaacactgaaaggtacagcaatgtatgcactggtctcaacgacacaatggagaatctgctggcatctgtggacaagaacgaggcagagatctcgccatcaacactatatgccattgcctgtgtcatggagggggtgccgttcattaatgggagcccccagaacacctttgtgcctgggctgatcgatcttgctattaagaacaactgcttgattggtggtgacgacttcaagagtggacagaccaagatgaaatctgtcttggttgatttccttgttggtgctggaataaagcccacctcaattgtgagctacaaccacttgggaaacaacgatggcatgaacctgtctgcccctcaaacattcaggtccaaggagatctccaagagcaatgtggtggatgacatggtctcaagcaatgctatcctctatgagcccggcgagcatcccgatcatgttgttgtcatcaagtatgtgccgtatgtgggagacagtaagagggctatggatgagtacacctccgagatcttcatgggcggcaagaacaccatcgtgctgcacaacacctgtgaggactcactactcgccgcacctatcatccttgatctggtgctcctggctgagctcagcaccaggatccagctaaaagctgagggagaggacaagttccactccttccacccggtggccaccatcctgagctacctcaccaaggcacccctggttccgcctggcacaccggtggtgaacgctctggcaaagcagagggcgatgctggagaacatcatgagggcctgcgttggcctggccccagagaacaacatgatcctggagtacaagtgagcgaagtggtgtggcctgcagctatacatatgcaggaggctgctggaagggaactagaaaggcgagattagctgtgggattgtgttggcttctcgtgttttcttttgcgttctttcctggtcattgctgttacgcttctgtatttgtcggacccgtaactatctatcagggctctgctattagcggcacgaagcctgtaattgtatcagttatcgtatgataatctgatcgagggtgctagttcctctcggcattcctatagcgatttcctagtgttcattgcaagtgtcagagtcgatgccatcgaacagttttcctctcgcctgttcggattttaaatggtatgatgtgcaaccttttctttc

SEQ ID NO: 536 - DNA, 2051 bp, Switchgrass
cattcgaaacatgcttccgcccaaagcagcgcagccgcctcattcctcctctccatcctcctctctctctctctcgcgcgccgctcttcccgttccgttccaggagagcagtgaggcgggtagtagtggtcggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcacccaggcctccaccatcagggttggcagctacaacggggaggagatctacgcgccgttcaagagcctcctgcccatggtaaaccctgatgacattgtgttcggaggctgggacatcagcaacatgaacctggccgatgccatgacaagggccaaggtgctggacattgacctgcagaagcagctcaggccctacatggagtccatggtgccactccccggcatctatgatccggacttcatcgcagcaaaccagggttctcgtgccaacaatgtcatcaagggcaccaagaaagagcaggttgaccagatcatcaaggacatcagggagttcaaggagaagaacaaggttgacaaggtagttgtgctttggactgcaaacactgaaaggtacagcaatgtctgtgctggtctcaacgacacagtggagaacctcctggcatctgtagacaagaacgaggcggagatctcaccgtcgacgttgtatgccattgcctgtgtcatggagggtgtaccattcatcaatggaagcccccagaacacctttgtgcctgggctgattgaccttgctatcaagaacaactgcttgattggaggtgatgatttcaagagtggacagaccaagatgaagtctgttttggttgacttccttgttggtgctggaattaagcccacctcaattgtgagctacaaccacttgggaaacaacgatggcatgaacctgtctgcccctcaaacattccggtccaaggagatctccaagagcaatgtagtggatgacatggtctcaagcaacgctatcctttatgagcccggcgagcatcctgatcacgttgttgtgatcaagtatgtgccgtacgttggggacagcaagagagccatggatgagtacacctctgagatcttcatgggcggcaagaacaccatcgttctgcacaacacctgcgaggactcgctcctcgccgcaccaatcattcttgatctggtgctcctggctgagctcagcaccaggattcagctaaaagctgagggagaggagaagttccactccttccacccagtggccaccatcctgagctacctcaccaaggcacccctggttccccccggcacgccggtggtgaatgccctggcgaagcagagggcgatgctggagaacatcatgagagcctgcatcgggctggcccccgagaacaacatgatcctggagtacaagtgagcgctgcggctatgcagcagggggcgcctactggaagggaacaagaaaggcgagactagctgtgggactggtgttggcttctcgtttgtttttttgcgttctttcctgctcattgttgtacacttttgtaagggttttctcgtcaggtcgtgattatcagggctctgctattagcggcacgaaccctgaaactgtgtcgtatgataatgtgctgagggtgctagttgccctctgtattcctaagggattcctactagtgttcgttgcaaatatgtgttcgtcccatccgtgactcttgcgaagtgtttcccccatgtcttccgtcacaattccatggtgtaaaaatgctgccaagtccggctcctgccatc

SEQ ID NO: 537 - DNA, 1988 bp, Thellungiella halophilum
cgatacactgacaagtcgccacgtgtccaatccccctcttcgtcttctctataaatcgtcgctcttgctcgtcgattcgagatcacaaaaccaaacacagagcttaaccaagagagaaaagaagagagagtgagaaaatgttcatcgagagcttcaaggtagagagcccaaacgtgaagtacacagagaatgagatccattcggtgtacgattacgaaacgacagaggtagtccatgagaatcgtaacggtacttatcaatggattgtgaagcccaaaactgtcaaatacgatttcaaaaccgacactcgtgtccccaaattaggggttatgcttgttggttggggaggaaacaatggatcaactttaaccgctggtgtgattgctaacaaagaaggaatctcgtgggcgacgaaagacaaagtgcaacaagcgaattactttggttcactcactcaagcttcgtcgattcgtgtcggatcttacaatggcgaagagatctacgctcctttcaagagtctccttccaatggtgaatccagacgatgttgtgtttggtggttgggacataagtgacatgaacttagcagacgccatggctagagccagagtccttgacattgatctgcagaaacagcttagaccttacatggagcacatgatcccactccctggaatctacaatccagatttcatcgctgcgaatcaagggtcacgtgccaataacgtgatcaaaggtaccaagaaagaacaagttgatcacatcatcaaggacatgagggagtttaaggaaaagaacaaagtggataagctagttgttctttggacagccaatacagagcgttacagcgatgtgattgtagggcttaacgataccatggagaatctaatggcttctgtcgagaaggacgagtctgagatctcgccttctacgctttacgctatcgcttgtgttcttgaaggcatccctttcattaatgggagtcctcagaatacgtttgttcccggacttattgaattggctatttcgaggaattgtttgatcggtggggatgatttcaagagtggtcagactaaaatgaaatccgttttggttgatttccttgttggagctggtatcaagcctacttcgattgtgagctataatcatttgggaaacaacgatggcatgaacctctcagctccacagactttccgctctaaggagatctcaaagagcaatgtggtagacgacatggtggctagtaatggcatcctctttgagcctggtgaacaccctgatcatgtggttgtcatcaagtatgtgccgtatgttgccgatagtaaaagagctatggatgagtacacgtccgagatattcatgggagggaagaacacaattgttatgcataacacttgtgaggattctctcctggctgctccaatcatcttggatcttgttctgctcgctgaactgagcaccagaatccaattcaaagctgaaggagagggaaagtttcattctttccacccagtagctaccatactcagttacctcacgaaggcacctcttgtaccgccgggaacgccggttgtgaacgctctatcgaagcagagggcaatgctggagaacattcttagggcttgcgttgggcttgcgccagagaataacatgatcatggagtacaagtgaaggatatgatgaagaagcagcatagggacctaagagcttaggatatgcagcagaatcagaagagggacctaaaatgctcaattgttacctttatctatatcatattgtgtacattatatgaatgtgtgtgagagagatgacatgaagaagctttagggttaatttgtgtaataaggattggggtaagcgtatttgcgagaagattagctaagcttttggatcaaatgtgtaaaaaattttcaaagtgactatgcttgtttctccttgtagtataccaaatttatgatctatgaatataagttttcatataatcacgct

SEQ ID NO: 538 - DNA, 4283 bp, Amborella
cgtgtcactacagtggcactcgagcctataaatagagggatgggtatcgcaacgccaggcgcaagcgaaagcgagcgagggcttgggggacgattgtttagagagagagagagagggagagagagagccgctctctgtactgaaaaacgaaaaaagaaacagagagagcagctctcgttcgttgtgttgtgttttcttggattgaaatataacaagtttttggtggttttaattttagagagaagatgtttattgagagctttcgtgtggagagccctaatgttaagtacacagaggataagattgaatcggtgtacgaatatgagacgactgaggttgttcatgaaaataggaatggcaaatatgaatgggtggttaagcccaagactgtcaaataccacttcaacacggacactcgtgttcccaagctaggggtgatgctcgtgggttggggtggaaacaacggttctacgatcaccgctggagtaattgccaaccgagagggaatatcatgggcaaccaaagacaaggtgcagcaggccaactattttgggtcgctcacccaggcatcgaccatcagggttggctctttcaatggggaggagatgtacgctcctttcaagagcctactccccatggtgaacccagatgacattgttttggggggatgggacataagcgacatgaacctggctgactccatggctagagccaaggttctggacatcgatcttcaaaggcagctgaggccgtacatggagtccatggttcctcttcctggtatctatgatcccgacttcatagcagcgaaccagggctctagagctaacaatgtcatcaagggcaccaagaaggagcaggtgcaaaagatcatcaatgacataagggaattcaaggagacgaacaaagtggatatggtggtggtgctatggacggccaacacagagagatacagcgatgtggtggagggcctcaacgacaccatggagaacctcttggccgccgtcgataggaacgaggccgagatctccccttccaccctccacgccatggcctgcgtcttagagaacgtcccctttatcaatggaagcccccaaaacactttcgtacccggtttgattgagctggccataaagacaaacagcttgattgggggcgacgatttcaagagtgggcaaaccaagatgaagtctgtgctcgttgatttccttgtgggcgctggaatcaagcccacatcgatagtgagctacaatcacctcgggaacaacgatgggatgaatttgtcagcgccacagacgttcaggtccaaggagatatcgaagagtaacgttgtggatgatatggtctccagcaacggcatcttgtacgagcctggagagcaccctgaccacgtcatcgtcatcaagtacgtgccctatgtgggtgatagcaagagggccatggatgagtacacctccgagatattcatgggtgggaagagcaccattgttctgcacaacacttgtgaagactcactcctcgctgctccgatcattctcgacctcgtcctcctcgctgagctgagcacccgtattcaactcaaggcacatgagggagaagttccactccttccacccggttgccaccatccttagctacctcaccaaagctcccttggttccacctggtacaccagtggtgaatgccctctccaagcaaagggcaatgcttgagaacattatgagggcctgcattggtttggcccctgagaacaacatgatactcgagtacaagtagaggggaattctacatatttttcccttctttttttgtttttttttttgcttcatttctcatgtggtcgtgcgggtacaaggaggagtagtccgtgattttgaaagcttgaacaaataatatggctgggtggttattgccaaggtcgtctcttgtcatgtcttcagatggtttgcaagttatcgtggtccctcctctatgtctgtgtcttctattttgagtgactgagggctcaccttttatatccgtataatacaataagtaagaagtacagaaaatgttttcttttgggatctcaatctggaatgtattcaaggctgctgttgtaggctccattttagatatggaaaaaatggatttaattgtggacctcctggcccttcatttacctcttgaaagtttcttaaatttagttttgaaaggcatgtgttttttagaataacaaagtggtgggttcctcttagaggagccttatttttgtcctacataacaaattgtttggaatgtcatagtgttttaacgatttgtatatatgctacaaaacaaatgagttcatgcaatgatcgtatagtaatatgatataaccactttcaaaactatggtatggtatagtaatatgatataaccactttcaaaactatggtatggttgttagtttgatccaaattttgaaatatacattttttttttaggtttttttttttttacaagatgctttgatttagggtttagaatgatattttcattttttaatttttttggatggttttattattatgagataaacaatgttaaaaaaaaaaacaaaatgattttgagtttataatgggcaagattttgaaattcatcaaatgaatagtctagatttattttaagaggggatttattttgatcatatttagagtttaaattgattttttttttttggattaattattgagacgaagagagtgcaaaaatttaggtcatataaaaaataccacaaacatagtttttttaagtgccagtgtattatattatgatacaaccgttgtatgaaataactgttctataacaatggcttcgggttataatggctttgagttttggtagaccctcagtatcacaagcatttctattatgattcaaataataaactcctatcatcatctttttctttattaaaaaccatattctcaatagattttcaatcgcgtttttttgggtctactttttattcttttcaattttttaattcttttatttgaactaactcgcatctcttaacatatgttttatttggtcggtgccatacatgactatgccattttactctactctctcacattttattgcctgttagtgccacgtttaaattctctcatatagatttattttgaattctatttcatattgttttgtcactcattcatctcaacatcttcattttcgctgcattcattttatgagtatattgttttcttgtctatacaacattctattccatagaacaaagttggttttactgttgtcctatagaagttgcctttcaacttcattgatatgcggcagcgatcatataaaattcaaataataaattctaggcccgttgaaatataaggacaaatgatatgtatgagaaagaaatttatagtgattgggataaaaggagaagctgtacctcaaaatccgtcacaaaaaatgcaattttagctccaggtaataaattggtggtttgtgttttcaatttttttttttggtgattgttcagaaatgagtgtatatttcaaaacttggatcaaacaaatgaccataagatggtgttttaatgttgttacatcatattactatacaacggttgtataaaatcagtgccctttggtgattataaagcaaaaaaaatgatagtgatgaaactgaataatgaatttcaattcctaaaaacaagatatgttttgaggcgttatcgtgcagctgaacaatcgatttcaattcttaaaagcaatgtatattttgaggacatcagacggccagcaagtagcatcctcttgaaagaaagttttttaaaaaaaagtgatcaaagatggtgagggagaattagcacaggcatcagactagcgggcgagcgagtagcggggagaagtagaaaaaaaaaatttgaaaaagaggcagatggagaactacggctggcgaaagagccgggtcaaccctggccctattctctggagggcctgcccaatcctggttcagcccagattaggccaaagagggccctggcaaggccgggcccttgggtgtatccgggctatgctatactaatcaaaataacaaaaggggaagagatatgtcactgtctaatgataataaaattatttgagaattttaaaaagaaaaaaatccttctaaactctaaatctaagcatctcactaaagtagataagttatattaattgagtttaaaaaacactttttagagtatgtttttaaattttgtttttttatttttatgataattcattttaatggaaaaa

SEQ ID NO: 539 - DNA, 1800 bp, Thellungiella halophilum
ctaatgtcctatctcgtctataaaagatgagcttggtctcaaatcacaatgcattcagaagctctctccttcacaagcaccaattaaaaattctctcagtgtttttcagaaagagattagacaaaaatgttcatcgaaagcttcaaggttgattctcccaacgtgaagtacacagagaatgagattcactcagtgtacgactaccaaaccactgagcttgtccacgagaacaaaaacggtgcgtatcagtggaccgtgaagccaaaaaccgtgaaatacgagtttaagaccaacactcatgttcccaaacttggagtgatgctcgttggctggggagggaacaatggctctactttaaccgctggtgttatcgctaatcgcgagggaatatcctgggctacgaaggagaaagtgcaacaagctaactatttcgggtcattgacccaagcatcctctattcgggtcggatcatttaatggcgaagaaatctatgctcccttcaaaagtctcctccccatggtgaatccggcagaaatagtgtttggaggatgggacataagcgacatgaacttagcagacgcaatggcacgaggcaaagtcctagacatcgacctccaaaagcagctgcgaccgttcatggagcacatggtcccactccctggaatctacgacccagatttcatcgcagctaaccaggggtcacgtgccaaccacttgatcaaaggcaccaagaaacaacagctcgaacaagtcatcaaggacatcagggatttcaaagagaaaaacacagtggatagggtggtggtattgtggacgcgaacacagaaagatacagcaatgtgttggttggtcttaacgacacgacggagaatctaatgtcatctttggacaagaacgagtctgagatttctccatctacgctttacgctattgcttgtgttgttgagaacgttcctttcatcaacggaagcccacagaacacttttgtccctgggcttattgaattggcaatcaagagaaacagtttgatcggtggcgatgacttcaagagtggtcagaccaagatgaaatctgtcctcgtagatttccttgtcggcgcagggatcaaaccgacgtcgatagtgagttacaaccaccttgggaacaacgacggcatgaacttgtcggcgccacaaacattccggtcaaaggagatatcgaagagcaatgtcgtcgacgatatggttgctagcaatggaattttatacgaacctggtgaacaccctgaccatgttgtcgtcattaagtatgtgccgtatgtaggagacagcaagagagcaatggacgagtacacatcggagatattcatgggagggaagaacacgattgtgatgcacaacacttgtgaagactctctcttagctgctcctattattttggaccttgttcttctcgccgagctcaccactcggatccagtttaaggccgaaaatgaggaaaagttccattctttccatccggtggctactctcctgagttacctctccaaggcaccattggtcccacccggcacgccagttgtgaacgctttgtcgaaacaacgtgcaatgcttgagaacgtactcagggcgtgtgttggacttgctcctgagaacaacatgattctcgagtacaagtgatgaagagatcaatcaatccgatcaaaatccaagattcgcctcttcgcattgtttgctttttttttttttaatgtccttaaatgaataattacattttcaaaatgtaacttttgatttcttatttacaaatattatccatgtt

SEQ ID NO: 540 - DNA, 2105 bp, Arabidopsis
cttgtcttcacgttaatcacgccacgtgtctgaacccaatttccaacgtgtctctcacattctcgaattcgactcttttagtggttctcgtcctctctgggcttttagactgggctcgaaccatctccattccaccgataacatcgaaacccgccacgtgtcctccctcctctgtctctcgtctatatatccacgctcttgttcgtcgattcgagatcacacacacaaccaccaaacacaaagcttttcaaaacccagagaaaatgttcatcgagagcttcaaagtagagagtccaaatgtcaaatacacagagaatgagatcaattcggtgtacgattacgaaacaacagaggtcgtccacgagaatcgtaacggtacatatcaatgggtcgtgaagccaaagactgtcaaatacgatttcaaaacagacactcgtgtccccaaattaggggttatgcttgttggttggggaggaaacaatggatcaacactaaccgctggtgtcattgctaacaaagaaggaatatcgtgggcgactaaagacaaagtgcaacaagctaattactttggttcacttactcaagcttcatcgattcgtgttggctcttacaatggtgaagagatctatgctcctttcaagagtcttcttccaatggtgaatccagaggatgttgtgtttggtggttgggatataagtgacatgaatttagcagacgctatggctagagctagagttcttgatattgatctgcagaaacaacttagaccttacatggagaacatgatcccacttcctggtatctatgaccctgatttcatcgctgctaatcaaggttcacgtgctaatagcgtgatcaaaggtaccaagaaggaacaagttgatcacatcatcaaggacatgagggagtttaaggagaagaacaaagtggataagttggttgtgttatggactgcaaacacagagcgttatagcaatgtgattgtaggacttaacgatacgacggagaatctattggcttctgttgaaaaggacgagtctgagatctcgccgtctacgttgtatgcgattgcttgtgttcttgaaggcattcctttcatcaatgggagtcctcagaatacttttgtccccggtcttatcgaattggctatatcgaagaattgtttgattggtggggatgatttcaagagtggtcagactaagatgaaatccgttttggttgatttccttgttggagctggcattaagcctacttcgattgtgagctataatcatttgggaaacaacgacgggatgaacctctcagcgccacagactttccgctctaaggagatttcaaagagcaatgttgtagacgacatggtagctagtaatggcatcctctttgagcctggtgaacaccctgaccatgtcgttgtcatcaagtatgtgccatatgttgcggatagtaaaagagcaatggatgagtacacgtctgagatattcatgggagggaggaacactatagtgttgcataacacttgtgaggactctctcttggctgcaccaattatcttggatcttgtccttctcgctgaactcagcaccagaatccaatttaaagctgaaggagaggggaagtttcactctttccacccggtagctaccatactcagttacctcacaaaggcacctcttgtaccgcccggaacaccggtggttaacgctctgtcgaagcagcgggcaatgctggaaaacattcttagggcatgtgttgggcttgcgccagagaacaacatgatcatggagtacaagtgaaggatgaggaagaagaagtaaaggtacctaagatgaccttaggatatgaaggacactgctccattgtttcatttatatatatcattttgtatgtatattatatgaatgtgtgtgtgacggataatatggataagcttagggttaacttgtgtgatatggatctggtcggtttatttggtgagaagattagctaagcttttggatcaaatgtgtaaaagatttaagtaattatgcttgtgtctccttgtaatataaccaaacttatgatctatgaatatggattttcaaaatcaaaatctctgtatttgt

SEQ ID NO: 541 - DNA, 1688 bp, Canola
gagagagagaagatgttcatcgagagctttaaggtagagagtccgaacgtgaagtacacagagaatgagatccattctgtgtacgattacgaaaccacagaggtcgtccacgagaaccgtaacggttcttatcaatggatcgtcaagcccaaaaccgtccaatacgatttcaaaacagacactcgtgtccccacgctaggggttatgcttgttggttggggaggaaacaatggatcgactctaaccgctggtgtgatcgctaacaaagaagggatctcgtgggcgactaaggacggagtgcaacaagcgaactactttggctcactcacgcaagcgtcttcgattcgtgtcggatcttacaacggcgaagagatctacgctcctttcaagagtcttctcccaatggtgaatccagacgacgttgtgtttggtggttgggacattagcgacatgaacttagcagacgctatggctagagctagagtcctcgacatcgatctccagaaacagcttagaccttacatggagcacatggtcccgctccctggtatctacgaccctgacttcatcgctgcgaatcaagggtcacgtgctaatagcgtgatcaaaggtacaaagaaagaacaagttgatcacatcatcaaggacatgagggagtttaaggagaagaacaaagtggataaggtggttgtgttatggacagccaacacagagcgttacagcgatgtggttgtagggcttaatgatacgatggagaatctattggcttctgttgagaagaacgagtctgagatctcgccttctacgctttatgctattgcttgtgttcttgaaggcgttccttttatcaacgggagtcctcagaatacttttgtcccggggcttatcgagctggctatatcaaagaactgcttgattggtggtgacgacttcaagagtggtcagactaagatgaaatctgttttggttgattttcttgttggagctggtatcaagcctacttcgattgtgagctataatcacttgggaaacaacgatgggatgaacctctcagcgccgcagactttcagatccaaggagatttcaaagagtaatgttgttgatgacatggtggctagtaatggcatcctctttgaacctggtgaacatcctgaccatgttgttgtcatcaagtatgtaccgtatgttgcggatagtaagagagccatggatgagtacacctcggagatattcatgggagggaagaatacaattgttatgcataacacttgtgaggattctctgttggctgctccaatcatcttggatcttgttcttctcgctgaactcagcaccagaatccaattcaaagccaaaggagaggggaagtatcactctttccacccagtagcaaccatactcagttacctcacaaaggcacctctagtaccgcctggaacgccggtggttaacgctctatcgaagcagagggctatgctggagaacattcttagggcctgcgttgggcttgccccagagaacaacatgatcttggagtacaagtgagaggacagggaggacgaagaagagcaaaaaggatctaaaactttagcttaagcttttggatcaaatgtgtaatagacttaaagagtaactatctttgtgttatatcaaactttatttattttatttatatcatgaatctcttc

SEQ ID NO: 542 - DNA, 2466 bp, Foxtail_millet
atggcatgttgcccgtttcaactatggcatattgtggtccctacccagagatcctctctaccgctggtgaaacaggaaaataagaaggatgaatatgcaaattcacacagcacaaatcattttgctcctccatcttcctcccgaaccatcgtccatcccgacggctcgccgtcttttctctctcactgtctcacagcctcacaggccgccgccggtcgacgcccctccggccctccccccagtcccccccgttccggtctcccgtctccgctgcctgcgatattggcggacctccggcaacggcaagcccccggcggctcaaaccgtctctcgcgcgctcctccctcccgtggggtccgcactttcaagcggggcccggaatagccagctactcgcgtgcagccacgtggcagtggccgtcgaaccggctataaattccccgccccgggcacccatccccgatcacaccccagagcagcgcagccgcctcctccctcctttcgctcgcgctactcttcgcattccattccaggagagcagcgagcggggtagtggtccgatcgagaggggaggagaggcaagatgttcatcgagagcttccgcgtggagagtccgaacgtgcggtacggcccgtcggagatcgagtcggagtaccggtacgacacgacggagctggtgcacgagggcaaggacggcgcctcccgatgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcacccaggcctccaccatcagggtcggcagctacaacggggaggagatctacgccccgttcaagagcctcctgcccatggtgaaccctgatgacattgtgttcggaggctgggacatcagcaacatgaacctggctgattccatgaccagggccaaggtgctggacatcgacctgcagaagcagctcaggccttacatggagtccatggtgccacttccgggcatctatgatccggacttcattgcagctaaccagggttctcgcgccaacaatgtcatcaagggcaccaagaaagagcaggttgaccagatcatcaaggacatcagggagttcaaggagaagaacaaggtggacaagatagttgtgctgtggactgcaaacactgaaaggtacagcaatgtctgtgctggtctcaacgacaccgtggagaacctcctggcatctgtagacaagaacgaggcagagatctcaccatcgacgttgtatgccattgcctgtgtcatggagggtgtaccattcatcaatggaagcccccagaacacctttgtgcctggcctgattgaccttgctatcaaaaacaactgcttgattggtggtgatgatttcaagagtggacagaccaagatgaagtctgttttggttgatttccttgttggtgctggaataaagcccacctcaattgtgagctacaaccacttgggaaacaacgatggcatgaacctgtcagcccctcaaacattccgctccaaggagatctccaagagcaatgtggtggatgacatggtctcgagcaacgctatcctttatgagcccggcgagcatcctgatcacgttgtcgtgatcaagtatgtgccctacgtcggggacagcaagagagccatggatgagtacacctctgagatcttcatgggcggcaagaacaccatcgtgctgcacaacacctgcgaggactcgctcctcgctgcaccaatcatacttgatctggtgctcctggctgagctcagcaccaggatccagctgaaagctgagggagaggagaagttccactccttccacccagtggccaccatcctgagctacctcaccaaggcgcccctggttccccccggcacaccggtggtgaacgctctggcgaagcagagggcgatgctggagaacatcatgagggcctgcgtcgggctggcccccgagaacaacatgatcctggagtacaaatgagcgctgcgggctactggaagcctggaagggaacaagaaaggcgagactagctgtggggctgtgtgtggcgtctcgtgtttcttttttttagttttttccggtcattgttgtacacttttgtatgggttcttcaggctcgtaactatcagggctctgctattagcggcatgaagcctgtaattgtatcgtatggtaatgtgatcgagggtgctagttcccctctgtattcctaagaccactttgcttccttaggcttatatgtggccagacgggccgctcggcacggcactcgcacgggcactatctggcacggccctacacggcacaacactgtatgatagcttagtcgtg

SEQ ID NO: 543 - DNA, 1945 bp, Nasturtium
gacatcaataaggaggtttgcgagatagatagagaggaagagaggaagagaaagtaaaataaacgcccctttttctctttctttctaagataaaaataatattgttttgcaaattcaaattccatattttcgtttcgtttgcattgtttgtgtatacttattctttctgttcaaaatgtttatcgagagctttaaagtagagagtcccaatgtgaattactcagagaatgagatccattctgtgtatgattatcagaccaccgaccttgttcatgagaacagaaatggcacttatcagtggattgtgaagcctaaatctgtcaaatatgaattcaagaccgatactcgtgtccctaaactaggggtgatgctcgtgggatggggagggaacaatggatcaaccctcactgccggtgtgactgcgaacagagaaggaatttcctgggctacgaaagagaaggtgcaacgagccaattattttggatcgctcacacaagcatcaacaattagagttggatcatttaacggagaagaaattcatgctccattcaaaagccttctccctatggttaatcctgatgacattgtgtttgggggatgggacattagtgacatgaacatggcagatgccatggccagagccaaggtgttggacattgatttgcaaaaacagctccggccttacatggagcacttggttccgctccccggaatatacgaacctgatttcattgctgcaaatcaagggtcacgtgctaacaacgtgattaaagggacaaagaaggagcaagttcaacaaatcatcaaggatattagtgagtttaaggagaagaacaaggtagacaaagtggttgtgctttggactgccaacacagaaaggtacagcagtgttgttgtcgggctaaatgacaccatggaaaatcttttggcctctttggagaaaaatgaagaggaaatttctccttcaacattgtatgctattgcttgtgtgcttgaaaacattccattcatcaatggaagccctcagaatacttttgttccagggctaatcgatttggctattaagaagaacagtttgattggtggtgatgacttcaagagcggtcagacaaaaatgaaatctgtgttagttgatttccttgttagtgctggtattaagccaacatccatagtgagttacaaccatcttggaaacaatgatggcatgaatctttcagccccccaaactttccggtcaaaggagatctcgaaaagcaatgttgttgatgatatggtctctagcaatgctattctctatgagcctggtgaacatcctgatcatgttgtggtcatcaagtacgtgccatacgtaggagatagcaagagagcaatggatgagtatacatcagagatcttccttggtgggaagagcaccattgtaatgcacaacacttgcgaggactcccttttggctgcccctatcattcttgacttggtccttctagctgagcttagcactaggattcagcttaaagcagaacaggagggaaagttccatccattccatcctgtggcaacacttcttagttatctatctaaggcccctcttgttccacccgggacaccagtggtgaatgccctgtcgaagcagcggtcgatgcttgagaatataatgagggcgtgtgtggggttggctcctgagaataacatgattttggagtacaagtaaaatcttcgaagcttgaagaagaaatggaagcagaaaagttgaaaggaacaattaattagggttacttctttcgctttcttgttaatttaaagtctttagctttgtttaaattatgcatgcatgcttaaatataatctataatgatgttttaacattttgtgctctttgtctagcgtcgtgcgctctcttttctatttgggaatagacaaattaattatatatgtaaaaaaaaaaaaa

SEQ ID NO: 544 - DNA, 1927 bp, Phalaenopsis
gataaacgtagtccgtagtcttgttaagtagtcgaagacgaggtaaagtcacccttttcttcgcttctaacctcttttccatcaccttcttcggaactttagagagagagagaaacaagggcgaaaatgttcgtcgaaagcttcaaggtcgagagccctaatgtgaagtatggagagcaagagatccactccatttacaactatgaaaccacggaattagtgcacgagagccggaatggatcctatgcctggatcgtgaagcctaagaccgtccaatacgagttcaagaccgatacccttgttcccaagctcggtgtgatgcttgtgggttggggagggaacaatggatccaccctcactgctgcggttattgctaatagagaggggatctcatgggccacgaaggataatgttcagcaggccaactattttgggtcactcacccaggcctccaccattaggattggctcttacaatggggaggagatttatgctcctttcaagagcttgcttcctatggtgaacccagatgaaattgtgtttggaggatgggacataagcaacctaaacctagcagattcgatgactagagccagggtcttggacattgatcttcagaagcaacttaggccctacatggaatccatggttcctcttcctggtatctacgatccagatttcatcgccgccaatcaagattcccgtgccaacaatgtcatcaaaggaaccaagagtgagcaagtccaacaagttattaaggatattagggagttcaaggataagaacaatgtagataaagtcgtcgttctttggactgcaaacactgagaggtacagcgatgtgatggttggcctcaatgacaccactgagaatctccttgcatcattggaaagaaatgagactgagatctccccatccaccttgtatgctattgcctgcgtcatggagaacattccattcatcaatggaagcccacaaaacaccttcgtgcctggacttattgattttgccattcagaggaacagtcttattggaggagatgacttcaagagcgggcaaacaaagatgaaatccgtcctcgttgattttctcgtcggtgcagggatcaagccaacctccattgttagctacaaccatcttggtaacaacgatggcatgaacctctctgcaccacaaacatttcgttcaaaagagatctcgaagagcaatgtcgtcgatgatatggttacgagcaacggaatcctctatcaaccaggggagcatcccgaccatgtcgttgtcataaagtatgtgccttatgttggggatagcaaaagggcgatggacgagtatacctccgagatcttcatgggtgggaaaaacacgatcgttattcacaacacctgcgaggactcactacttgctgcacctataattcttgatttggtgctcctggctgagcttagctccagaattcagttcaaggctgagggggagggaaagttccattccttccatcctgtggcaaccatactgagctacctgactaaagctcctcttgttccacccggcacacctgtggtgaacgccctctcaaaacagagggctatgctggagaacatactgagggcttgcattggcctggctccagaaaacaatatgattctggagtacaagtgagacttcctgaaaagggtcggagaactgaaggctatatgagtggcggaactataagattgcagatttggttctctaccccatttttcttcttccaattattatataatatgcaattgttgtcgactcccggtgattatggtaaatcaacttgtgttcaaatcttatgattctgtttttcaattcaagtgcggaaacctgtgcgagccgctagtagctctcttataacaataatgcgtgactttttctactaatattaaatccttttatt

SEQ ID NO: 545 - DNA, 1943 bp, Poppy
tcttcttcttcttcttctacatttgagatcgtggggcttgtttgattttcttgaaaatgtttattgaaaatttcaaagtagagagtccaaatgtcaagtatacagaggaagggattgaatctgtgtacaattatgaaactactgaactgatccatgagaataagaatggtgcttatcaatggactgttaaacctaagtctgttcagtatcaattcaaaactgataccaaagttcctaaacttggtgttatgcttgttggatggggtggaaacaatggatcaacacttacaggtggtatgattgctaacaaagagggaatctcttgggctaccaaggataaagtacaacaagcaaattactttggttcactcacacaagcttcaacaatccgggttggatcttttaatggagaagaaatctatgctccattcaagagcttacttcccatggttaatccggatgatattgtattgggaggatgggacataagtgacatgaacttagctgatgctatgtccagggcaagagtgtttgatattgatttgcagaaacaattgagaccatacatggaatcaatggttccacttcctggaatttatgatcctgattttattgctgctaatcaaggctctcgtgctaataacattatcaaaggaaccaagaaagaacaagttcaacaaatcatcaaagatatcagggagtttaaggaagctaacaaagtggacaaagttgttgtactttggactgcaaacactgaaagatacagcaatgtaattgttggattgaatgataccgaagaaagtctcgtagcttcagtggaaaagaatgaagctgaaatttcaccttcaactctgtatgctttggcttgtatctatgaaaatattccatttatcaatggaagccctcagaacacatttgttccagggttgattgatttggcaattaagcataatactttaattggtggagatgatttcaagagtggtcagactaagatgaaatccgtgttggttgatttccttgtgggggctggtatcaagccaacttcaattgtgagctataatcatttgggaaacaatgatgggatgaatttgtctgcgccacaaacatttaggtcaaaagagatatcaaagagtaatgttgtggatgatatggtttcaagcaatggtattctctatgagcctggtgaacatcctgaccatgtcattgtcatcaagtatgtgccatatgtgggagatagtaagagagcaatggatgaatacacctctgaaatattcatgggtggaaaaagcacaattgttatgcacaacacgtgcgaagattcacttttggctgctccaataatcttggatctggttcttctggctgaactcagcacccgtatccaactcaagtctgagaaagaggggaagtttcactccttccatcccgtttctaccattcttagctacctcaccaaggcccctctggttccaccaggtacaccagtggtgaatgctttgtccaagcagagggcaatgcttgagaacatcatgagagcatgtgttggtttggctccagagaataacatgattttggagtacaaatgaatgggtttccacctaaatctagaagtggtgtgtgaaatgtcttgtaattgaagctattgtaatcacattggtcacctctttagctggtttaatgtaattagggggttttagtacatgggtttgttttagtttgtcatcctcttctccggaagggccagggaattgatgtagtagttcacatgatggatatcctatggtctgaagttaaagtttcaaaagagaggagattgggtttttatttaatggttgtcatatctatgtacttttctcttgtgttttctttaggtgtagtggtaaagactaaagacaagtgtttttcatctgtttgtgtacactattttgattcctccagct

SEQ ID NO: 546 - DNA, 1950 bp, Radish
ggacaaccacaaacacgatcattccaaaaccgagaaaacaaaggtatctgtaaaagatgttcatcgagagcttcaaagttgagagcccgaacgtgaaatacacagagaatgagattcattcggtgtacgattacgagacgacggaggtcgttcacgagaacgttaacggtgcttaccaatggatcgtgaagcccaaggttgtcaaatacgatttcaaaaccgatactcgtgtccccaaattaggggttatgcttgttggttggggaggaaacaatggatcaaccctcaccgccggtgtaattgccaataaagaaggaatctcgtgggcgacaaaggacaaagtgcaacaagcgaactacttcgggtcgttaacacaagcatcgtctattcgtgtcggatccttcaacggtgaagagatctatgctcctttcaagagtctcgttccaatggtgaatccggatgatgttgtgtttggaggatgggacataagtgatatgaatttagcagacgctatggggagagccaaggttcttgacattgatctgcagaaacagcttaggcctttcatggagaacattgtcccactccctggtatcttcgatcctgatttcgtcgctgccaatcaggggtcacgtgccaacaacgtcatcaaaggtaccaagaaggaacaagtcgaccaaatcatcaaggacatgagggagtttaaggagaagaacaaggtggataaggttgtggttctgtggacgggyaacacagagcgttacagcaatgtgatcgtggggctaaacgacacaatggagaatcttatgaagtctgtggaaagggatgagtctgagatctctccttccacgctttatgcgattgcatgtgttcttgaaggcatccccttcatcaatggaagccctcagaacacctttgtcccaggtcttattgatttggctatcaagaacaatgttttgatcggtggtgatgacttcaagagtggtcaaaccaagatgaaatccgtcttggttgatttccttgttggtgctggaatcaagcctacttcaatagtgagctacaatcacctagggaacaacgatggaatgaacctctcagctccacagacattcagatctaaggagatctccaaaagtaatgtggtggatgatatggttgctagcaacggtatcctcttcgagcccggggaacaccctgaccatgttgttgtcatcaagtatgtaccgtatgttgcagatagcaagcgagccatggatgagtatacatcagagatattcatgggtggcaagaacacaattgtgatgcacaacacctgcgaggactctctcctagctgctccaattatcttggatcttgttctcctcgctgaactcagcaccaggattcagttcaaatccgagaaagaggggaagtttcattctttccatcctgtggccactatactcagctacctcaccaaggcaccgctcgtgccgcctggaacaccggtggttaatgcgttgtctaagcagcgggcgatgctggagaacattcttagggcctgcgttgggctggctccggagaacaacatgatcttggagtacaagtgaacatgaagcgtataagaaccttcgatgagttcattatataaagacttttaagttcctttgtttggttttttttcttaattatgtgttttaaaatatgaatgcttgtgttttcagagatcagagagcttttggtttgatctctgttgggtgtgaagtaacttgtatttctagtaatccagatgggttatatagttttattgtacaagtgtttctaggttggaccataatttcatataatcgctttatggttcacttccatactgtgtaaacttctttttttttcatattgtgtaaacttcttgtaatttgcgttatataatcatgatttccgtccaatgaaatttgtcaattttaattctgg

SEQ ID NO: 547 - DNA, 2026 bp, Switchgrass
agcagcgcagccgcctccttcctcctcctcttctccctctctctcgcgctgctcttcgcgttccgttccaggagagcagtgaggcaggtagatagtggtggtcgatcgaccgagagggtagggcaggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtaccacttccggaccagcaccgccgtccccaagctcggggtgatgctcgtagggtggggcggcaacaacgggtccacgctgacggctggggtcatcgccaacagggaggggatctcatgggcgaccaaggacaaggtgcagcaagccaactacttcggctccctcacccaggcctccaccatcagggttggcagctacaacggggaggagatctacgcgccgttcaagagcctcctgcccatggtaaaccctgatgacattgtgtttggaggctgggacattagcaacatgaacctggccgatgccatgaccagggccaaggtgctggacattgacctgcagaagcagctcaggccatacatggagtccatggtgccacttcccggcatctatgatcccgacttcatcgcagcaaaccagggttctcgcgccaacaatgtcatcaagggcaccaagaaagagcaggttgaccagatcatcaaggacatcagggagttcaaggagaagaacaaggtggacaaggtagttgtgctgtggactgcaaacactgaaaggtacagcaatgtctgtactggtctcaacgacacagtggagaacctcctgaaatctgtagacaagaacgaggcggagatctcaccgtcgacgttgtatgccattgcctgtgtcacggagggtgtaccattcatcaatggaagcccccagaacacctttgtgcctgggctgattgaccttgctatcaagaacaactgcttgattggaggagatgatttcaagagtggacagaccaagatgaagtctgttttggttgatttccttgttggtgctggaattaagcccacctcaattgtgagctacaaccacttgggaaacaatgatggcatgaacctgtcggcccctcaaacattccggtccaaggagatctccaagagcaatgtggtggatgacatggtctcaagcaacgctatcctttatgagcccggcgagcatcctgatcacgttgtcgtgatcaagtatgtgccgtacgttggggacagcaagagagccatggatgagtacacctctgagatcttcatgggcggcaagaacaccatcgttctgcacaacacctgcgaggactcgctcctcgccgcaccaatcattcttgatctggtgctcctggctgagctcagcaccaggattcagctaaaagctgagggagaggagaagttccactccttccacccagtggccaccatcctgagctacctcaccaaggcacccctggttccccccggcacgccggtggtgaacgccctagcgaagcagagggcgatgctggagaacatcatgagggcctgcgtcgggctggcccctgagaacaacatgatcctggagtacaagtgagcgctgcgggctatgcagggggcgcctactggaagggaacaagaaaggcgagactagctatgggactgtgttggcttctcgtttgttttttttgccttctttcctgctcattgttgtacaagtatgggtttgttcgtcaggtcgtaattatcagggctctgctattagcggcacgaatcctgtaactgtgtcgtatgataatgtactgagggtgctagttcccctctctattcctaagggattcctactagtgttcgttgcaaatatgtgtgagtgactcttgcgtagtgtttcccatgtcttccgtcacaatttccatggtgtgaaaatgctgccaattccggctcctgcc

SEQ ID NO: 548 - DNA, 2096 bp, Wheat
ccgcacacaattcactccagccccttgccaccgcactcgaaaacctctctcttcctccctgcaagagtctccaggaaagaaagagagggagagatcgatcttgcgtcgccaagatgttcatcgagagcttccgcgtggagagcccgaacgtgaggtacggcgcgggggagatcgagtccgagtaccgctacgacaccacggagctggtgcacgagagccacgacggcgcctccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggcgaccaaggacaaggtgcagcaggccaactactttgggtccctcacccaggcctccaccatcagggtcgggagctacaacggagaggagatctatgcgcccttcaagagcctcctgcccatggtaaacccagatgaccttgtgtttgggggctgggacattagcagcatgaacctggctgatgctatgaccagggccaaggtgctggacattgacctgcagaagcagctcaggccctacatggagtccatcgtgccgctccccggcatctatgacccggacttcatcgctgccaaccagggctcccgggctaacaatgtcatcaagggcacaaagaaagagcagatggagcagattatcaaagacataagggagttcaaggagaagaacaaggtcgacaaggtagtggtgctttggacggcaaacactgaaaggtacagcaacgtctctgttgggcttaatgacacgatggagaacctcttggcgtctgtggacaagaacgaggcagagatatccccatcaacactgtatgccattgcctgcgtcatggagggtgtgccgttcatcaacgggagccctcagaacacctttgtgcctgggctgatcgatcttgccattaagaacaactgcctgattggtggtgatgatttcaagagtggccagactaagatgaaatctgtcttggtggatttccttgttggtgctggaatcaagcccacctcaattgtcagctacaaccatctggggaacaacgacgggatgaacctatccgcaccgcagacattccgttccaaggagatctccaagagcaacgtggtggatgacatggtctcgagcaatgctatcctctacgagcccggggagcatcctgaccacgtcgtcgtgatcaagtacgtgccatacgttggagacagcaagagggccatggacgagtacacctcggagatcttcatggggggcaagagcaccatcgtgctgcacaacacctgcgaggactcgctcctcgctgcacccatcattcttgatctggtgctcctggcggagctcagcaccaggattcagctgaaggccgagggagaggacaagttccattccttccatccggttgccaccatcctgagctacctcaccaaggcacccctggttcctcctggcacgccggtggtgaacgccctggcgaagcagagggcgatgctggagaacatcatgagggcgtgtgtcggcctggcgcccgagaacaacatgatcctggagtacaagtgaggagcgtggcccaagctcgcggagccgagagcgaccgtacgtacgtagcaagtggcgaggggcgacgggagggcaggaggaagaagaaggcgagatcggctgtggaattatttggcggcttgtctttagtttcctttgcgaatctttccctggttaagtttaccccagtgagtgtgtgtccttgcgagactatttcggctctctcccaagtctctgcgtcttggtagcttctcatggactccatggtgttggatgatgtggagggaggagggtgcgtgttagctaagttagtccactccctctgttcgtgttttgtaagttaattagtagtatgtatgctactagtatatggaactttaaatcggttcaccggcgagttgtgtgctctgcttttatcatgtcacctcccggtcgttccgggacggcgagcagtactgttttttttgaaac

SEQ ID NO: 549 - DNA, 2007 bp, Wheat
tgccaccgcactcgaaaacctctctcttcctccctccaagagcctccaggaaagagagagagggagagatcgatcctgcgctgccaagatgttcatcgagagcttccgcgtggagagcccgaacgtgcggtacggcgcgggggagatcgagtcggagtaccgctacgacacgacggagctggtgcacgagagccacgacggcgcctccaagtgggtcgtccgccccaagtccgtcaactaccacttcaagaccaacaccaccgtccccaagctcggggtgatgcttgtggggtggggcggcaacaatggctccacactcatggctggggtcatcgccaacagggaggggatctcatgggcgaccaaggacaaggtgcagcaggccaactactttgggtccctcacccaggcctccaccatcagggtcgggagctacaacggagaggagatctatgcgcccttcaagagcctcctgcccatggtaaacccagatgaccttgtgtttgggggctgggacattagcagcatgaacctggctgatgctatgaccagggccaaggtgctggacattgacctgcagaagcagctcaggccctacatggagtccatcgtgccactccccggcatctatgacccggacttcatcgctgccaaccagggctcccgggctaacaatgtcatcaagggcacaaagaaagagcagatggagcagattatcaaagacataagggagttcaaggagaagaacaaggtggacaaggtagtggtgctttggacggcaaacactgaaaggtacagcaacgtctctgttgggcttaatgacacgatggagaacctcttggcgtctgtggacaagaacgaggcagagatatctccgtcaacactgtatgccatcgcctgcgtcatggagggtgtgccattcatcaacgggagccctcagaacacctttgtgcctgggctgatcgatcttgctattaagaacaactgcctgattggtggcgatgatttcaagagtggccagaccaagatgaaatctgtcttggtggatttccttgttggtgctggaatcaagcccacctcaattgtcagctacaaccatctggggaacaacgatgggatgaacctatctgcgccgcagacattccgttccaaggagatctccaagagtaacgtggtggatgacatggtctcgagcaatgctatcctctacgagcccggggaacatcctgaccacgtcgtcgtgatcaagtatgtgccatacgttggagacagcaagagggccatggacgagtacacctcggagatcttcatgggcggcaagagcaccatcgtgctccacaacacctgcgaggattcgctcctcgccgcaccgatcattcttgatctggtgctcctggccgagctcagcaccaggattcagctgaaggccgagggagaggacaagttccactccttccatccggttgccaccatcctgagctacctcaccaaggcaccccttgttcctcctggcacgccggtggtgaacgccctggcgaagcagagggccatgctggagaacatcatgagggcgtgcgtcggcctggcgcccgagaacaacatgatcctggagtacaagtgaggagcagggcccaagctcgcggggacgagagcgaccgtacgtacgtagcaagtggcgaggggcgacgggagggcaggaggaagaagaaggcgagatcggctgtggaattatttggcggcttgtcttcggtttcctttgcgattctttctttccctggttaagtttaccctggtgtgagtgtgtgtgtgtccttgcgagactatttcggctctctgtctggcctctgcgacttggtagattctcatggactccatggtgttggatgatgtggagggaggagggtgcgtgttagctaagttagtccactccccttgttcgtgttttgtaagctaattagtagtatctgtactactagtatatggaactttcaatcggttcaccggcga

SEQ ID NO: 550 - DNA, 1678 bp, Cleome gynandra
agagagagagaatgttcatcgataatttcaaggtcgagagcccgagcgtgaagtacacggagaatgagattcactctgtgtatgattatgagacgacggaggtcgttcatgagaacgttaatggtgcttaccagtggattgtgaagccaaagaaggtcaaatatgaattcaaaaccgatattcatgtcccaaaactaggggttatgcttgtgggttggggaggtacaatggctccaccctcaccgccggtgtaatcgctaatagagaaggaatttcatgggcgaccaaagacaaagtgcagcaagcaaattacttcggttcagttactcaagcatcatccattcgcgtcgggtcgtataatggagaagagatctatgctcctttcaagagccttcttcccatggtaaatcctgatgatgttgtattcggtggatgggatattagtgacatgaatttggcagatgccatggcaagagctagggttcttgacattgatctgcaaaagcaactcaggccttacatggaaaacatagtcccactccctgggatctacgatcctgatttcatcgctgccaatcaagggtcacgtgccaacaacgttgtcaaaggttgtaagaaggaacaagtggatcaaatcatcaaggatatcagggaattcaaagagaagaacaaggttgataaagttgtagtgttatggactgcaaatacagaacgttacagtaatgtcattgttggattaaacgatacaatggaaaatctattggcatctgttgacaagaatgaatctgagatttcaccttcgaccctttatggcattgcctgtgttatggaaggtgttccattcatcaatggaagccctcaaaatacttttgttccaggtcttatcgatatggccattaggagaaattgtttgattggtggggatgacttcaaaagtggtcagaccaagatgaaatccgtcttggttgatttcctcgttggagctggtatcaagcctacatcgattgtaagctacaatcatttaggtaacaacgacgggatgaatctttcagccccacaaacatttcgttccaaagagatatcgaaaagtaacgtcgtggatgatatggttgctagtaacggtatccttttcgagcctggtgaacatcctgaccacgtcgttgtcataaagtacgtaccatacgtagcggatagcaaaagggcgatggatgaatacacttccgagatattcttaggaggaaaaaacacgattgtaatgcataacacttgcgaggattctcttttggccgcgcccattatattggatctcgttcttttagcggaacttagtacgaggattcaactcaaagccgaaggcgagggcaaattccattctttccatcctgtggccaccatcctcagctacctcaccaaggcacctcttgttccgccagggacgccggtggtgaatgccttatcgaagcaaagggcgatgctggaaaacataatgagagcttgtgttgggctttcgccggaaaacaatatgatattagaatacaagtgaaagaggaatgaccaacttaattatgaatatgaatgtgtgaagaacataagaattatttttgtcttttcagtattttggtttttaaaatataataactttgtatgttatttcttctctttgttatcttagtgctaa

SEQ ID NO: 551 - DNA, 1722 bp, Onion
gttactgatttcctaactccaaaatgttcatcgaaaacttcaaggtcgagagcccgaatgtgaagtacggggaggatgagatcgaatcgatttacaattacgagacgacggagttggttcacgaaagcagaaatggctcgtatcagtggatcgttaagcctaaaactgttcagtacaacttcaaaactgacgtgcatgttcccaagcttggggtgatgcttgtgggatggggaggtaacaacgggtctacacttactgcaggtgtcattgcaaacagagaagggatttcctgggcaaccaaggacaagatacaaagagcyaattactttggatcgttgacgcaggcatcggcsattagagttggatctttcaacggagaggaaatttatgctccgtttaagagtcttttaccaatggtaaacccggatgacattgtgttcggtgggtgggacataagtaacatgaacatggcagatgcaatggcaagagcaaaagttcttgacatagacctacaaaaacagttgagaccctacatggaatccatggtccctcttcctggaatcttcgatcctgacttcattgcatctaaccaaggcgcacgtgcaaatcatactattaagggcaccaaaaaggagcaagtccaacawatcattaaagacatgagggaattcaaggagaagaacaaagtagacaagatagtcgtkctctggactgcaaacactgaaaggtatagcaaygtagtcgttggactgaacgayaccatgaagaatctcatggcttccttggaaaaagacgagcatgagatatctccctctactctttatggaattgcttgtgttatggagaatgttccttacattaatggaagccctcaaaacacctttgtgcctggtttgatagagatggcaattcagagaaactgccttattkggtggtgatgatttcaagagtgggcagactaagatgaagtctgtcttggttgattttcttgttggggctggtatcaagccaacttcaattgtgagctacaaccatctaggcaacaacgatggaatgaacctttctgctcacaaacattcagatcgaaggagatatccaaaagcaacgttgttgatgacatggtctccagcaatggcatcttgtacgaacctggtgaacatcctgatcatgttgttgtaatcaagtatgtgccatatgtgggagacagtaaaagggcgatggatgagtacacatcggagatattcatgggcggtaaaagcacgatcgttctccacaatacttgtgaagattcactgctggctgctcccattatccttgatctggttcttcttgcagaactcagcactaggattcagctcaaggctgaaggagaaggaaaattccactctttccaccctgtggctaccatcctgagttacctcaccaaagctcctctggtacctccaggtacgccagtggttaacgcactatcgaagcagagggcgatgcttgagaacatactgagggcttgtatcggattggcacctgagaacatatgattttggagacaaatgagagatgtattgtgtgatgaaatgatgcgtttggcgaaggagatgaaagatgattgtctcttctttttgaatgaagactctctgtatgatatgtgtgggcatctttctttatgcctagcgtttatggatgctttctgggttgaaatcttcagacgtctagatttatggt

SEQ ID NO: 552 - DNA, 1584 bp, Petunia
gatatacacgttcagttagttcaaagactagttccctacttcatttggtttcttaatattttataaacattttcttgatctttgtttgtgttctacatttgttaaaaatgtttattgaaaattttaaggtagaaagtccaaatgtgaagtacaccgagagtgagattcactcactgtatgattatgaaacaacagaacttgttcatgaagaaagaaatgggacttatcaatggattgttaagccaaaaactgttaaatatgagttcaagactgatactcatgttcccaaattaggggttatgcttgttggatggggtggaaacaatggttcaacattgactggaggtgtcattgctaatagagaaggaatttcatgggcaacaaaagagaaggttcagcaagccaattactttggttctcttactcaggcatctacaattagagttgggtctttcaatggtgaagagatctatgctcccttcaagagtctccttcccatggtcaacccagatgatgtagtgtttggagggtgggacattagcaacatgaatttggcagatgccatggtcagggcaaaggttttcgacattgatttgcaaaaccagctgaggccctacatggaatccatggttccccttcccggtatctatgatcctgacttcattgctgctaaccaagaatcacgtgccaacaatgtgatcaaaggaaccaagaaagagcaagttgatcaaattatcaaagatattagggagttcaaggaaaagaacaaggtagacaaggtagtggtcctttggactgcaatacagaaagaacagcaatgtggttggtggtcttaatgacacaatggaaaaccttatggctgctgtggatagaaatgaggctgaaatatctccatccacattgtatgctattgcttgtgttcttgaaaatgtgcctttcatcaatggaagcccacagaacacatttgtcccaggtcttattgatttggccataaagaggaatactttaattggtggtgatgactttaagagtggtcaaaccaagatgaagtcagtgctggttgatttccttgttggagctggtattaagccgacatcaatagtgagctacaatcacttgggcaacaatgacggaatgaatctttcagcccctcaaactttccggtctaaggagatctcaaaaagcaatgttgttgatgacatggttgccagcaatgccatcctctatgaatcgggcgagcaccctgaccatgttgttgtgattaagtatgtcccatacgttggagacagcaagagggcaatggatgagtacgcatcagagattttcatgggtggaaagaacacaattgttttgcacaatgtgtgcgaggactctcttttagcagctccaattatcttggacttggtcctcctcgctgaactcagcactcgcattcagcttaaagctgaaggagagggaaagtttcactctttccatcctgtggctactatcctcagctacctcaccaaggctcctctggtgccaccaggtacaccagtggttaatgcactttccaagcagagggcaatgcttgagaacataatg

SEQ ID NO: 553 - DNA, 2273 bp, Maize
attcggctcgctgtcttctttctatcgctcacaaccaacaaccatagcccacaggccgccggcgcccgccagccgacgtcctcccatttcgctcccctcctccgctgcggtcgagcaaaagttccggccatccggcaatcccccggcacccggcggttcaaatcgtatctgacctgacgcggctacgacgtcgctcctccggtcccttcgatccggtggggtccgtttctttcaagcgcggcctcgctggccgcctcgtggcagtgaccgtcgaaccctctataaatcccgtgccccgagcacccttcctcgatcacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttgtggggtggggaggcaacaacgggtccacgctgacggctggggtcattgccaacagggaggggatctcatgggcgaccaaggacaaggtgcagcaagccaactactacggctccctcacccaggcctccaccatcagagtcggcagctacaacggggaggagatctatgcgccgttcaagagcctccttcccatggtgaacccagacgacattgtgttcggaggctgggacattagcaacatgaacctggccgactccatgaccagggccaaggtgctggatattgacctgcagaagcagctcaggccctacatggagtccatggtgccacttcccggtatctatgatccggacttcatcgcggctaaccagggctctcgcgccaacagtgtcatcaagggcaccaagaaagaacaggtggagcagatcatcaaggatatcagggagtttaaggagaagaacaaagtggacaagatagttgtgttgtggactgcaaacactgaaaggtatagcaatgtgtgcgctggtctcaacgacacgatggagaatctgctggcatctgtggacaagaacgaggcggagatatcgccatcaacactatatgccattgcctgtgtcatggagggggtgccgttcatcaacgggagcccccagaacacctttgtgcctgggctgattgatcttgctataaaaaacaactgcttgattggtggtgacgacttcaagagtggacagaccaagatgaaatctgtcttggtcgatttccttgttggtgctggaataaagcccacctcaatcgtgagctacaaccacttgggaaacaacgatggcatgaacctgtctgcccctcaaacattcaggtccaaggagatctccaagagcaacgtggtggatgacatggtctcgagcaatgccatcctctatgagcccggcgagcatcccgatcatgtcgttgtcatcaagtatgtgccgtacgtgggagacagcaagagggctatggacgagtacacctcagagatcttcatgggcggcaagaacaccatcgtgctgcacaacacctgtgaggactcgctcctcgccgcacctatcatccttgatctggtgctcttggctgagctcagcaccaggatccagctgaaagctgagggagaggacaaattccactccttccacccggtggccaccatcctgagctacctcaccaaggcacccctggttccccctggcacaccggtggtgaacgctctggccaagcagagggcgatgctggagaacatcatgagggcctgcgttgggctggccccagagaacaacatgatcctggagtacaagtgagccaagtggcgtgccctgcagcgcgaggttagctgctggaagggaactagaaaggcgagattagctgtgggattgtgttgggcttgtcgtgttttcttttgcgttctttcctagtcattgctgttgcgcttttgtatttgtcggacccgtaactaccagggctctgctattagcggcacggagcctgtaattgtattgtatgataatgtgatcgagggtgctacttcccctcggcattcctagtgttggttaaaagtcgttcgacagcaacttatcgacccaccactgacttcaccctatccgccgg

SEQ ID NO: 554 - DNA, 2236 bp, Poppy
cagagtgatagatagatagatagaaacaaggagaaattttcttttttgcttcttcttcttcttcttctgcatttgagatcctggggcttgtttgattttcttcaaaatgtttattgaaaatttcaaagtagagagtccaaatctaaagtatacagaggaggggattgaatctgtgtacaattacgaaactactgaacttatccatgagaataagaatggtgcttatcaatggactgttaaacctaagtctgttcagtatcaattcaaaactgatactaaagttcccaaacttggtgttatgcttgttggatggggtggaaacaatggatcaacacttactggtggtatgattgctaacaaagagggaatctcttgggctaccaaggataaagtacaacaagcaaattattttggttcactcacgcaagcttcaacaatcagagttggatcttttaatggagaagaaatctatgctccattcaagagcttacttcccatggttaatccagatgatattgtgttgggaggatgggacataagtgacatgaacttagcagatgctatgtccagggcaagagtatttgatattgatttgcagaaacaattgagaccatacatggaatcaatggttccacttcctggaatttatgatcctgattttattgctgctaaccaaggttctcgtgctaataacattatcaaaggaaccaagaaagaacaagttcagcaaatcatcaaagatatcagggaatttaaggaagcaaacaaagtggacaaggttgttgtactttggactgcaaacactgaaagatacagcaatgttattgttggtctaaatgatactgaagaaagcctcttagcttctgttgaaaagaatgaagctgagatttcaccttcaactttgtatgctttggcttgtatctatgaaaatattccatttatcaatggaagccctcagaacacatttgtcccagggttgattgatttggcaattaagcataatactttaattggtggagatgatttcaagagtggtcagactaagatgaaatctgtgttggttgatttccttgtgggggctggtatcaagccaacttcaattgtgagttataatcatttgggaaacaatgatgggatgaatttgtctgcgccacaaacatttaggtcaaaagagatatcaaagagtaatgttgtggatgatatggtttcaagcaatggtattctttatgagcctggtgaacatcccgaccatgtcattgtcatcaagtatgtgccatatgtgggagatagtaagagagcaatggatgaatacacctccgaaatattcatgggtggaaagagcacaattgttatgcacaacacgtgcgaagattcacttttggctgctccaattatcttggatctggttcttctggctgaactcagcacccgtatccaactcaaatctgagaaagaggggaagtttcactcattccatcccgtttctaccattcttagttacctcaccaaggcccctcttgttccacctggtacaccagtggtgaacgctttgtcaaagcagagggcaatgcttgagaacatcatgagagcatgtgttggtttggctccagagaataacatgatcttggagtacaaatgaatggttgcaactaaatttataagtggtgtgttcgaaatgtgttgtaattgaagctattgtaatcacactgctaatctctttagctggtttaatgtaattagagaggggtttgggtttgttattttagtttatcatcttctccgtgagggccagggaattgatgtagtagttcacaagggaattgttgtttgatatcttatggtccgaagttgagtttcaaacgagagaggagattgggtttctatttaatggttgtcaaatgtatgtactgttctcctttgttttctttaggtgtagtaaagacgagtgttcttctccatttgtttgtctgcattattttgattcctcctccatttgcagaaagcttttccttgaatttccaagggatttagagcctttagactgccccaagtgtgcaactgttttgcggtgtaaattcgggcaggtcaggccgcccgactcaaaaaagacaggccggcaggcctgtaaaaaaattcaggccgagaaggttgggtaaaagtagataatttgctacccaaagtccatctaagtccgttttttatacgggcaggtcagatccggccggataggccacta

SEQ ID NO: 555 - DNA, 1926 bp, Arabidopsis lyrata
attccatcgataactccgaaaacccgccacgtgtcctccctcctctgtttctcgtctatatatcatcgctcttgttcgtccattcgagatcacacaaccaccaaacacagagcttcaagatacaaacatttcttatatacacaaagaaaatgttcatcgagagctttaaagtagagagcccaaatgtcaaatacacagagaatgagattcattcggtgtacgattacgaaacaacagaggtcgtccatgagaatcgtaacggtacatatcaatggattgtgaagccaaagtctgtcaaatacgatttcataacagaaactcgtgtccccaaattaggggttatgcttgttggttggggaggaaacaatggatcaacactaaccgctggtgtcattgctaacaaagaaggaatctcgtgggcgactaaagacaaagtgcaacaagctaattactttggttcactaactcaagcttcttcgattcgtgttggttcttacaatggtgaagagatttacgctcctttcaagagtcttcttccaatggtgaatcctgatgatgttgtgtttggtggttgggatataagtgacatgaatttagctgatgctatggctagagctagagttcttgacattgatttgcagaaacaacttagaccttacatggagaacatgatcccgcttcctggtatctatgaccctgatttcattgctgcgaatcaagggtcacgtgctaatagcgtgatcaaaggtaccaagaaggaacaagttgatcacatcatcaaggacatgagggagtttaaggagaagaacaaagtggataagttggttgtgttatggactgcaaatacagagcgttatagcaatgtgattgtagggcttaatgatacgatggagaatctattggcttctgttgaaaaggacgagtctgagatctcgccttctactttgtatgctattgcttgtgttcttgaaggtatccctttcatcaatgggagtcctcagaatacttttgtccccggtcttatcgagttggctatatcgaagaattgtttgattggtggagatgatttcaagagtgggcagactaagatgaaatccgttttggttgatttccttgttggagctggcatcaagcctacttcgattgtgagctataatcatttgggaaataacgacgggatgaacctctcagcgccgcaaactttccgctctaaggagatttcaaagagcaatgttgtagacgacatggtagctagtaatggcatcctctttgagcccggtgaacaccctgaccatgtcgttgtcatcaagtatgtaccatatgttgcggatagtaaaagagcaatggacgagtacacgtctgagatattcatgggagggagaaacacaattgtgatgcataacacttgtgaggactctctcttggctgctccaattatcttggatcttgttcttctcgctgaactcagcaccaggattcaattcaaagccgaaggagaggggaagtttcactctttccacccggtagctaccatactcagttacctcacaaaggcacctcttgtaccgcctggaacaccggtggttaacgctctgtcgaaacagcgggcgatgctggaaaacatactcagggcctgcgtggggcttgcgccagagaacaacatgattatggagtacaagtgaaggatgaggaagaagaagtaaaggtacctaagaccttaggatgtgaagaagactgctccattgtttcctttatatatattatatgaatgtgtgtgggagagagataatatggagaagcttagggttaatttgtgtgatatggatctggtctgtttatttggtgagaagatttggatcaaatgtgtaaaagaattaagagtaactatgcttgtgtctccttgtaatataaccaaatttatgatct

SEQ ID NO: 556 - DNA, 2343 bp, Brachypodium
gaggggtttttgttttcgggtgaaggaaagggggggcttgttaatttcgctcacgatctcccgaaggctcggttatattctcccgaatcgatcgatctctccccacgctggccgctcctctctgactctagctaccgccgccggccttcccagtctctctctcgcgctcccaccggctgcgaagcggagctttgtttctctgccgcctcgccgcgcagaggccagcgccttcggagtgggacctgagcacagccagccgctactgcggtactgccgccccgccacgtggcctcccaaaacccctataaatcccccattcattcgcccatctccgatcacacagctctctgctcctctccaccctcactgcagcagaaatcccttggccccccttctcttctctcacccttcgtctgaactccactgaggagtcgaagaagatgttcatcgagagcttccgggtggagagcccgaacgtgcggtacggcgcgggggagatcgaggcggagtaccggtacgacacgacggagctggtgcacgagagccacgacggcgcctccaagtgggtcgtccgccccaagtccgtcaactaccacttcaagaccaacacaaacgtccccaagctcggggtgatgcttgtgggatggggcggcaacaatggctctacgctgatggctggggttatcgctaacagagaggggatctcatgggcaaccaaggacaaggtgcagcaagccaactactttggctctctcacccaggcttccaccatcagggttgggagctacaacggggaggagatctatgcgcccttcaagagcctcctgcccatggtgaacccagatgaccttgtgttcggtggctgggacattagcagcatgaacctggctgatgctatgaccagggccaaggtgctggacattgacctgcagaagcagctcaggccctacatggaatccatcgtgccgcttcccggcatctatgacccggacttcattgctgccaaccagggttcccgggctaacaatgtcatcaagggcaccaagaaagagcagatggaacagattatcaaggacataagggatttcaaggagaagaacaaagtggacaaggtggtggtgctgtggactgcaaacactgaaaggtacagcaacgtcagtgttgggctcaatgacacaatggagaacctcttggcgtctgtggacaagaacgaggcagagatatctccatcaacactgtatgcaattgcctgcgtcatggagggtgtaccgttcatcaatgggagtcctcagaacacctttgtgcctgggctcatcgatcttgctattaagaacaactgcctgattggcggtgatgatttcaagagtggccagaccaagatgaagtctgtcctggtcgatttccttgttggtgctggaatcaagcccacctcaattgtcagctacaatcatctggggaacaatgatgggatgaacctatctgcaccgcaaacattccgttccaaggagatatcgaagagcaatgtggtggatgacatggtctcaagcaatgctatcctctacgagcctggggagcatcctgatcatgtcgtcgtgatcaagtatgtgccatacgttggagacagcaagagggccatggatgagtacacctcggagatcttcatggggggcaagagcaccattgtgctgcacaacacctgcgaggactcgctcctcgctgcaccgatcattcttgatctggtgctcctggccgagctcagcactaggattcagctgaaagccgagggagaggataagttccactctttccatccggttgctactatcctgagctacctcaccaaggcgccccttgtccccccgggcacaccagtggtgaacgctctggccaagcagagggccatgctggaaaacatcatgagggcctgcgtcggcctggcccctgagaacaacatgatcctggagtacaagtgaaggaggaggagcaggacggagggcgccgtgcgtgcggagccgagagcaaccgtagcaagaggcgcatggatggaatgggcacgaggaagtcgagattactagtagctgtggaatcactcagcttgtcttgtgtttctttggcgattctttccctcgatgttagttgatcactaccccctctgtgttttcgagactctgttcgggcacgaagctttcttggcttgtattcctctgttcttaagttaagttagtgttgttggtactttcagtttaccgatagacttatttcgagctcgtcttcggttgcctttctcgttgtgttggtttggtttgatggttcactgttagcgagcgacatggttcacgcctt

SEQ ID NO: 557 - DNA, 1691 bp, Canola
cacaaagcttaaagattaaagagagagagagaagatgttcatcgagagctttaaggtagagagcccgaacgtggagtacacagagaatgagatccattccgtgtacgattacgaaaccacagaggtcgtccatgagaaccgtaacggttcttatcaatggatcgtcaagcccaaaaccatcaaatacgatttcaaaacagacactcgtgtccccaaactaggggttatgcttgttggttggggaggaaacaatggatcgactctaaccgctggtgtgatcgctaacaaagaagggatctcgtgggcgactaaagacggagtgcaacaagcaaactactttggctcgctcactcaagcgtcttcgattcgtgtcggatcttacaacggcgaagagatctacgctccattcaagagtcttctcccgatggtgaatccggacgatgttgtgtttggtggttgggacataagcgacatgaacttagcagacgctatggctagagccagagtccttgacatcgatctccagaaacagctcaggccttacatggagcacatggtcccgctccctggtatctacgaccctgacttcatcgctgccaatcaagggtcacgtgctaatagcgtgatcaaaggcacaaagaaagaacaagttgatcacatcatcaaggacatgagggagtttaaggagaagaacaaagtggataagctagttgtgttatggacagccaacacagagcgttacagcgatgtggttgtagggcttaatgatacgatggagaatctattggcttctgttgagaagaacgaggctgagatctctccctccacgctttatgcaattgcttgtgttcttgaaggcattccttttatcaacgggagtcctcagaatacttttgtcccggggcttatcgagctggctatatcgaggaactgcttgattggtggggatgacttcaagagtggtcagactaagatgaaatctgttttggttgattttcttgttggagctggtatcaagcctacttcgattgtgagttataatcacttgggaaacaacgatgggatgaacctctcagcgccgcagactttcagatctaaggagatttcaaagagtaatgttgttgatgacatggtggctagtaatggcatcctctttgagcctggtgaacatcctgaccatgtcgttgtcatcaagtatgtaccatatgttgcggatagtaagcgagccatggatgagtacacctcggagatattcatgggagggaagaatacaattgtaatgcacaatacttgtgaggattctctgttggctgctccaatcatcttggatcttgttcttctcgcggaactcagcactagaatccaattcagagccaaaggagaggggaagtatcactctttccatccagtagcaaccatactaagttacctcacaaaggcgcctctagtaccgcctgggacgccggtggttaacgctttatcgaagcagagggctatgctggagaatattcttaggggctgcgttgggcttgcgccagagaacaacatgatcttggagtacaagtgaaggacagggaggatgaagaagagcaaaaggatctaaaactttagcttaagcttttggatcaaatgtgtaatagacttaaagagtaactatctttgtgttaaaccaaactttctttattttattt

SEQ ID NO: 558 - DNA, 2112 bp, Rye
cacacaattcactccagcccccctgccaccgcactcgagaccctctctctctcgctccaacagtctccgggaaagagagagagggagagagaacgatcttgcgttgccaagatgttcatcgagagcttccgcgtggagagcccgaacgtgcggtacggcgcgggggagatcgagtcggagtaccgctacgacaccacggagctggtgcacgagagccacgacggcgcatccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggccaccaaggacaaggtgcagcaagccaactactttgggtccctcacccaggcctccaccatcagggtcgggagctacaacggagaggagatctatgcgcccttcaagagcctcctgcccatggtgaacccggatgacattgtgtttgggggctgggacattagcagcatgaacctggctgatgctatgaccagggccaaggttttggacattgacctgcagaagcagctgaggccctacatggagtccatcacgccgctccctggcatctatgacccggacttcatcgctgccaaccagggctcccgggctaacaatgtccttaagggtacaaagaaagagcagatggagcagattatcaaagacattagggagttcaaggagaagaacaaggtggacaaagtagtggtgctttggacggcaaacactgaaaggtacagcaacgtctctgttgggcttaatgacacgatggagaacctcttggcgtctgtggacaagaacgaggcagagatatccccatcaacactgtatgccatcgcctgcgtcatggagggtgtgccgttcatcaacgggagccctcagaacacctttgtgcctgggctgatcgatcttgctattaagaacaactgcctgattggtggcgatgatttcaagagtggtcagaccaagatgaaatctgtcttggttgacttccttgttggagctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccacgtcgtcgtgatcaagtatgtgccatatgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggagaggacaagttccattccttccacccggttgcgaccatcctgagctacctcaccaaggcacccctggttcctcctggcacgccggtggtgaacgccctggcgaagcagagggcgatgctggagaacatcatgagggcgtgcgtcggcctggcgcccgagaacaacatgatcctggagtacaagtgaggagcaccgcccaagctcgcggagccgagagagaccgtacgtacgtagcaagtggcgaggggcgacgggagggctggaggaagaagaaggcgagatcggctgtggaattatttggcggcttgtctttagtttcctttgcgattctttccctggttaagtttaccctagtgtgtgtgtgtgtgtgtctccttgcgagactatttcggctctttgcgacatggtagcttctcatggactccatggtgttggatgatgtggagggaggagggtgcgtgctagcttaaagttagtccaccccctctgttcgtgttttgtaagttaattagtagtatgtgtactactagtatatggaactttcaatcggttcaccggacgaaaaaaaaaaagaaaaaaaaaagaaaaaaaaaagaaaaaaaaaagaaaaaaaaagaaaaaataaactatatagtatactacactctctctaga

SEQ ID NO: 559 - DNA, 1946 bp, Rye
gactgaatccattggaatctcgcgtgcccgtgtccacggaatcgttggtgatcccggcgcctggcactggcaccggcagaggctctccccagcccgccgacggcgaagttgtctcgccgccgccccgcttggcactggcaggccctctcctcggcgctctcgcacctgcggcgtggaccccagcgaaaccacgtggccgcgtaacccgctataaatcccccaccccgccgcccgcccaccaccgcagatcacacacaattcactccagcccccctgccaccgcactcgagaccctctctctctcgctccaacagtctccgggaaagagagagagggagagagaacgatcttgcgttgccaagatgttcatcgagagcttccgcgtggagagcccgaacgtgcggtacggcgcgggggagatcgagtcggagtaccgctacgacaccacggagctggtgcacgagagccacgacggcgcatccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggcgaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgaccagggccaaggttttagacattgacctgcagaagcagctgaggccctacatggagtccatcactccgctccccggcatctatgacccggacttcatcgctgccaaccagggctcccgggctaacaatgtccttaagggtacaaagaaagagcagatggagcagattatcaaagacatcagggagttcaaggagaagaacaaggtggacaaggtagtggtgctttggacggcaaacactgaaaggtacagcaacgtctctgttgggcttaatgacacgatggagaacctgttggcgtctgtggacaagaacgaggcagagatatctccgtcaacactgtatgccattgcctgcgtcatggagggtgtgccgttcatcaacgggagccctcagaacacctttgtgcctgggctgatcgatcttgctattaagaacaactgcctgattggtggcgatgatttcaagagtggccagaccaagatgaaatctgtcttggtggatttccttgttggtgctgggatcaagcccacctcaattgtcagctacaaccatctggggaacaacgatgggatgaacctatctgcgccgcaaacattccgttccaaggagatctccaagagcaacgtggtggatgacatggtctcaagcaatgctatcctctacgagcccggggagcatcctgaccacgtcgtcgtgatcaagtatgtgccatacgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggggaggacaagttccattccttccacccggttgcgaccatcctgagctacctcaccaaggcacccctggttcctcctggcacgccggtggtgaacgccctggcgaagcagagggcgatgctggagaacatcatgagggcgtgcgtcggcctggcgcccgagaacaacatgatcctggagtacaagtgaggagcaccgcccaagctcgcggagccgagagagaccgtacgtacgtagcaa

SEQ ID NO: 560 - DNA, 2480 bp, Thellungiella parvulum
cttgtcttcacgtagatcacgccacgtgtatggacccagcttccaacgtgtctctcacattctagtttcatccacgcgtgtgaacccagcacgtgtggtttagtggctcttagggcttgagagttgtgggctcggttcgctaactgattcaaccatctccactcgcttgtggaaactgaagggaccatcgcaaacactgacaaaccgccacgtgtccctctttctcttcgtcttgtctatatatcctcgctcttgctcgtcgattcgtgatcacaaaaccaaacacagagcttaaagcaaaagagagagagagaatgttcatcgagagctttaaggtagagagcccaaacgtgaagtacacagagaatgagatccattctgtgtacgattacgaaactacacaagtcgtccacgagaatcgtaacggtacttatcaatggattgtgaagcccaaaactgtcaaatacgatttcaaaacagacactcgtgtccccaaattaggggttatgcttgttggttggggagggaacaatggatcaactttaaccgctggtgtaattgctaacaaagaaggaatctcgtgggcgacaaaagacaaagtgcaacaagccaattactttgggtcactcactcaagcgtcttctattcgtgtcggatcttacaatggcgaagagatctatgctcctttcaagagtctcctaccaatggtgaatccagacgatgttgtgtttggtggttgggacataagtgacatgaacttagcagacgccatggctagagccagagtccttgacattgatctgcagaaacagctcagaccttacatggagcacatgattccactccctggaatctacaatcctgatttcatcgctgcgaatcaagggtcacgtgccaatagcgtgatcaaaggtaccaagaaagaacaagttgatcacatcatcaaggacatgagggagtttaaggagaagaacaaggtggataagttagttgtgctatggacagccaatacagagcgttatagcgatgtgattgtgggacttaacgatacaatggagaatctattggcttctgttgaaaaggacgagtctgaaatctcgccttctacgctttacgccattgcttgtgttcttgaaggcatccctttcattaatgggagtcctcagaatacttttgttcctggtcttatcgaattggccatttcgaagaattgtttgatcggtggggatgatttcaagagtggtcagactaagatgaaatctgttttggtcgatttccttgttggagctggcatcaagcctacttcgattgtaagctataatcatttgggaaacaacgatggtatgaacctctcagcgccgcagacttttcgctctaaggagatttcaaagagcaatgtggtagacgacatggtggccagtaatggcatcctctttgagcctggtgaacatcctgaccatgttgttgtcatcaagtatgtaccatatgttgcggatagtaagagagcgatggacgagtacacctccgagattttcatgggaggaaagaacacaattgtaatgcataatacttgtgaggattctcttttagctgctccaatcatcttggatcttgttcttctcgctgaactcagcaccagaattcaattcaaagccgaaggagagggtaagtttcactctttccacccagtagctaccatactcagttacctcacaaaggcaccacttgtaccacctggaacaccggtggtgaatgctctatcgaagcagcgggcaatgctggagaacattcttagggcctgtgttggccttgcaccagagaataacatgatcatggagtacaagtgacgaacgaggatagagaagaagcagagggacctaaggccttaggatatgagacttataatgctccactgtttcgtttatataatgttatatatgaagtgtgtgagagatatcacattatgaagcttagggttaatttgtgtgataatgatctggggcagtttatttggtgagaggattagctataagcttttggatcaaatgtgtaatagacttgagagtaattatatttgtgcctccttgtaatatatcaaatttatgatctatgaaaatgggttttcataatcacaactttctctgtttatatatggatgtaatgaatcttcatcaataagggacatcaacaaagaacatagaaaggtaagagaaccttgaagaaaccattaatgggtttgatcaagaactgccagcagaaaccatcgtgaactcgccttcgcaaaccaacgagccacccacgtaagatttaccttccatcttagcaagcccgaaccgtttctggaacttgagaagagtcatcctcatgaccagtgtgtctccagcaatcactggtttccggaatcgaactttatcaatacccgcaaagaagaagttatcctgagaccctccgatttccggctgcagcattactatacctcc

SEQ ID NO: 561 - DNA, 1928 bp, Arabidopsis lyrata
cacttctccgctgattagaagcacaaaactcacccaaaatcgatccaaattccgagaaatataacagttttttcttttcctctggaaaaatgttcattgagagcttcaaagttgagagccggaacgtgaagtacacagagaatgagattcactctgtttacgattacgagacgacggaggttgttcatgagaagaccatcaatggcagttaccaatggattgtgaagccaaagactgtcaaatacgatttcaaaaccgatattcgtgtccccaaattaggggttatgcttgtgggttggggaggaaacaatggatcaactctcactgctggtgtcattgcgaacaaagaaggaatctcgtgggctacgaaggacaaagtgcaacaagcgaattacttcggttcactaactcaagcatcatcgattcgtgtcggatcctttaacggtgaagagatctatgctcctttcaagagtctccttccaatggtgaatccggatgatgttgtgtttggagggtgggatataagtgacatgaacttagcagatgccatggctagagccagggttctcgatatcgacttgcagaaacagctcaggccttacatggagaacattgtgccactccctgggatctatgatcctgattttatcgctgctaatcaagggtcacgtgctaaccacgtgatcaaaggtaccaagaaggaacaagtcgaccacatcatcaaggacatgagggagtttaaggagaagaatcaggtggataaggttgtggttctctggacggctaacactgagcgttatagcaatgtggtcgttgggatgaacgatacaatggagaatctcatggagtctgtggatagggatgaggctgagatctctccttcaacgctttatgcgattgcttgtgttcttgaggggatcccgttcatcaatggaagccctcagaacacctttgttccaggtctaattgatatggcgatcaggaacaatgttttgatcggtggagatgatttcaagagtggtcaaaccaagatgaaatctgtcttggttgatttccttgttggtgcaggaatcaagcctacttcaattgtgagctacaatcacttggggaacaacgatgggatgaacctctcagctccccagacattcagatctaaggagatctcgaaaagcaatgttgtggacgatatggttgctagcaacggtatcctctttgagcctggggaacacccggaccatgttgttgtcatcaagtatgtaccctatgttgcggatagtaagcgagcgatggacgagtacacatcagagatcttcatgggagggaagaacacaattgtgatgcacaatacctgcgaggactctctcttagctgctccaatcatcttggatcttgttctcctcgcagagctcagcaccaggatccagttcaaatctgagggagagggaaagtttcattctttccatcctgtggccaccatactcagctacctcaccaaggcaccgcttgtgccgccgggaaccccggtggttaacgcgctgtcgaaacagcgggctatgctggagaacattctgagggcgtgcgttgggctggctccggagaacaacatgatcatggaattcaagtgaacaggaagaagcatctaagacctttaatttgctcataatttaaagagtctttaatttgtgtcgttgtttgttttttattttatgttttaaattatgaaagcttgtgtttctaagagatcaaagagcttttagttcggtctctgtagggtgtgaagtaacttgtatttgtagtaatccggatgggttggtatattttgaaagtgtttctaggttggaccataattccaatatctcttatgatttggtttcatatgtgtgtaaacaacttctattttgagatatataatcatggttttggtccag

SEQ ID NO: 562 - DNA, 1530 bp, B. juncea
atgttcatcgagagcttccgcgtggagagcccgcacgtgcggtacggcgcggcggagatcgagtcggactaccagtacgacacgacggagctggtgcacgagagccacgacggcgcctcccgctgggtcgtccgccccaagtccgtccgctacaacttccggaccaccaccaccgtccccaagctcggggtgatgctcgtggggtggggcggcaacaacggctcaacgctgacggctggggtcatcgccaacagggagggaatctcatgggcgaccaaggacaaggtgcagcaagccaactactatggctcactcacccaggcgtccaccatcagggtcgggagctacaacggggaggagatctacgcgcccttcaagagcctcctgcccatggtgaaccctgatgaccttgtgttcgggggctgggacattagcaacatgaacctggctgatgctatgaccagggcaaaggtacttgacattgatctgcagaagcagctcagaccttacatggagtccatggtgcctctccccggcatctatgaccccgacttcatcgccgccaaccagggatcccgcgcgaacaatgtcatcaagggcaccaagaaggagcagatggagcagatcatcaaggacatcagggagttcaaggaaaagagcaaagtggacaaggtggtggtgttgtggactgcaaacactgaaaggtacagcaatgtctgtgttgggctcaatgacacaatggagaacctcctggcgtctgtggacaagaacgaggcggagatatcaccatcgacactgtatgccattgcctgtgtcatggagggtataccgttcattaacgggagtcctcagaacacctttgtgcctgggctgatcgatcttgctattaagaacaactgcctgattggtggtgatgatttcaagagtggacagacaaagatgaagtctgtcttggttgatttcctagttggtgctggaataaagcccacctcaattgtcagctacaaccacttggggaataatgatggcatgaacctttccgcacctcaaacattccgatccaaggagatctccaagagcaatgtggtcgatgacatggtctcaagcaatgccatcctctataagcctggcgagcatcctgatcatgttgttgtgatcaagtatgtgccgtatgttggagacagcaagagggcaatggacgagtacacctcagagatcttcatggggggtaagagcaccatcgttctgcacaacacctgtgaggactcacttcttgccgcgccgatcattcttgatctggtgctccttgccgagctcagcaccaggattcagctgaaagccgagggggaggagaagttccattccttccatccagtggctaccatcctgagctacctcaccaaggcaccccttgttcctcctggcacaccagtggtgaacgccctggcaaagcagagggcaatgcttgagaacatcatgagggcctgcgttgggctggcccccgagaacaacatgatcctggagtacaag

SEQ ID NO: 563 - DNA, 1943 bp, Arabidopsis
gcacgtctccgctgattagaagcacaaaactcacaccccaaaaccgatccaaattccgagaaagacaaccaaattttccttttcctctgcaaaaatgtttattgagagcttcaaagttgagagcccgaacgtgaagtacacagagaatgagattcactctgtgtacgattacgagacgacggaggttgttcatgagaagaccgtcaatggcacttaccaatggattgtgaagccaaagactgtcaaatacgatttcaaaaccgatattcgtgtccccaaattaggggttatgcttgtgggtttgggaggaaacaatggatcaactctcaccgctggtgtgattgcgaacaaagaaggaatctcgtgggcaacgaaggacaaagtgcaacaagcgaattacttcgggtcactaactcaagcttcatcgattcgtgtcggatcttttaacggtgaagagatctatgctcctttcaagagtctccttccaatggtgaatccggatgatgttgtgtttggaggatgggatataagtgacatgaacttagcagatgccatggctagagccagggttcttgatatcgacttgcagaaacagctcaggccttacatggagaacattgtgccactccctgggatcttcgatcctgatttcatagctgctaatcaagggtcacgtgctaaccacgtgatcaaaggtaccaagaaggaacaagtcgaccacatcatcaaggacatgagggagtttaaggagaagaataaggtggataaggttgtggttctctggacggctaacacagagcgttatagcaatgtggtcgttgggatgaacgatacaatggagaatctcatggagtctgtggatagggatgaggctgagatctctccttcaacactttatgcgattgcttgtgttcttgagggaatcccgttcatcaatggaagccctcaaaacacctttgttccaggtctaattgatatggcgatcaggaacaatgttttgatcggtggagatgatttcaagagtggtcaaaccaagatgaaatctgtcttggttgatttcctagttggcgcaggaatcaagcctacttcaattgtgagctacaatcacttgggaaacaacgatggaatgaatctctcagctccacagactttcagatctaaggagatctccaaaagcaatgtcgtggacgatatggttgctagcaatggtatcctctttgagcctggggaacacccggaccatgttgttgtcatcaagtatgtaccgtatgttgcggatagtaagcgagccatggacgagtacacatcagagatattcatgggagggaagaacacaattgtgatgcacaatacctgcgaggactctctcttagctgctccaatcatcttggatcttgttctcctcgcggagctcagcaccaggatccagttcaaatccgagggagagggaaagtttcactctttccatcctgtggccaccatactcagctacctcaccaaggcaccacttgtaccgccgggaactccggtgattaacgcactgtcgaagcagcgggctatgctggagaatattatgagggcgtgcgttggactggctccggagaacaacatgatcatggaattcaagtgaacatgaagaagcatgaatctaagacctttaattagctcataatttaagagtctttaatttgtgtcgttgtttggtttttatataatgtttttaaattatgaaagcttgtgtttctgagagaccaaagagcttttagtttggtctctgtagggtgtgaagtaacttgtatttgtagtaatccggatgggttggtatattttgcaagtgtgtctaggttggaccataatttcaatatctcttatgattttgtttcatatgtttgtaaaacagcttatcttttgagatatataatcatggttttggttcagcaatt

SEQ ID NO: 564 - DNA, 2001 bp, Rye
acacacaattcactccagcccccctgccaccgcactcgagaccctctctctctcgctccaacagtctccgggaaagagagagagggagagagaacgatcttgcgttgccaagatgttcatcgagagcttccgcgtggagagcccgaacgtgcggtacggcgcgggggagatcgagtcggagtaccgctacgacaccacggagctggtgcacgagagccacgacggcgcatccaagtgggtcgtccgccccaagtccgtcaactaccacttcaagaccaacaccaacgtccccaggctcggggtgatgctcgtggggtggggcggcaacaatggctccacactcatggctggggtcatcgccaacagggaggggatctcatgggcgaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgactagggccaaggttttggacattgacctgcagaagcagctgaggcctacatggagtccatcacgccgctccccggcatctatgacccggacttcatcgctgccaaccagggctcccgggctaacaatgtccttaagggtacaaagaaagagcagatggagcagattatcaaagacattagggagttcaaggagaagaacaaggtggacaaagtagtggtgctttggacggcaaacactgaaaggtacagcaacgtctctgttgggcttaatgacacgatggagaacctcttggcgtctgtggacaagaacgaggcagagatatccccatcaacactgtatgccatcgcctgcgtcatggagggtgtgccgttcatcaacgggagccctcagaacacctttgtgcctgggctgatcgatcttgctattaagaacaactgcctgattggtggcgatgatttcaagagtggccagaccaagatgaaatccgtcttggttgacttccttgttggtgctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccacgtcgtcgtgatcaagtatgtgccatatgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggagaggacaagttccattccttccacccggttgcgaccatcctgagctacctcaccaaggcacccctggttcctcctggcacgccggtggtgaacgccctggcgaagcagagggcgatgctggagaacatcatgagggcgtgcgtcggcctggcgcccgagaacaacatgatcctggagtacaagtgaggagcaccgcccaagctcgcggagccgagagagaccgtacgtacgtagcaagtggcgaggggcgacgggagggctggaggaagaagaaggcgagatcggctgtggaattatttggcggcttgtctttagtttcctttgcgattctttccctggtgaagtttaccctagtgtgtgtctccttgcgagactatttcggctctctgcgacatggtagcttctcatggactccatggtgttggatgatgtggagggaggagggtgcgtgctatcttaaagttagtccactccctctgttcgtgttttgtaagttaattagtagtatgtgtactactagtatatggaactttcaatccgttc

SEQ ID NO: 565 - DNA, 1621 bp, Arnica
actgagaatgaaatacactctgtttacaactacgataccaccgagctcgttcatgaggagaaaaacggtgcttatcaatgggttgttaagcccaaaaccgtcaaatacgagttcaaaaccgaaactaatgttcctaaattaggggttatgcttgttggatggggaggcaacaatggctcaaccctaaccgctggtgttatcgcaaatcgggagggaatatcttgggcaaccaaagaaaaaattcaacaagccaactactttggttctttgactcaagcatccactatcagagttgggtctttcaatggagaggagatctatgctcctttcaagagcctcctccctatggtgaacccagacgacatcgtatttgggggatgggacataagcagcatgaacctggctgattcaatggcaagagccaaggttttggacattgatttacagaaacagttaagtccttacatggaatccatggtcccactccctggtatctttgaccctgacttcattgctgccaaccaaggtgcacgtgcagacaactgcatcaagggaaccaaaaatgagcaaatccaaaaggtcattaaggatatcagggagtttaaggaagcaaacaaggtagacaaggtggttgttctgtggactgcaaacacagaaagatacagcaatgtgatggttgggcttaatgacacaatggaaagcctgtttgcatcattagacagaaatgaagctgagatatctccatcaaccttgtttgctatagcttgtattcttgagaatgttcctttcatcaatggcagcccccaaaacacttttgttccaggggttattgatttggctatcaagagaaacaccttgattggtggagatgactttaagagtggtcaaactaagatgaagtctgttcttgttgatttccttgttggagctgggatcaagccaacatccattgtgagctacaatcacttgggaaacaatgacggaatgaatctctcagctccacaaacattcagatccaaagagatctccaaaagcaatgtcgttgatgacatggtttccagcaacgcaatcttatacgagcccggagagcatcctgaccacgtggttgtcatcaagtacgttccatacgtgggagatagcaaaagagccatggatgagtacacatctgaaatattcatgggtggtaaaagcacaattgtactacacaacacatgtgaggactcacttctggctgctccaatcatcctggacttggtcctacttgcggagctaagcactcgcatccaactcaaatccgaaacagagggtaagttccattcattccatcctgtggctaccattctgagttaccttacaaaggcccctcttgtaccaccagggacaccagtggtaaatgcactagcaaagcagagggcaatgttggaaaacatattaagggcttgtgttggattggcaccagaaaacaacatgatcttggaatacaagtgaattaattcagcatcttttgctttgtattcttcatgtgatgttttttcagtatcaatttaccatcttttgtacccacaactgtgctttcatttgctttgctttgttgtttatttggagataaatatatataaat

SEQ ID NO: 566 - DNA, 2093 bp, Barley
gacaattcactcactccctaccaccacactcgagagcatttctctctccctctcgtctccctccaacactctctgtgtgagagatcgatcgagaggcaacactctccgtgagagagagagatcgagaggcagcagggagggagggagccaagatgttcatcgagagcttccgcgtggagagcccgaaggtgcggtacggcgcgggggagatcgagtccgagtaccgctacgacaccacggagctggtgcacgagagccacgacggcgcctccaagtgggtcgtccgccccaagtccgtcaactaccacttcaagaccaacaccaccgtccccaagctcggggtgatgctcgtggggtggggcggcaacaatggctccacactcatggctggggtcatcgccaacagggaggggatctcatgggcgacaaaggacaaggtgcagcaggccaactactttgggtccctcacccaggcctccaccatcagggtcgggagctacaacggagaggagatctatgcgcccttcaagagcctccttcccatggtgaatccggatgaccttgtgttcgggggctgggacattagcagcatgaacctggctgatgctatgaccagggccaaggtgctggacattgacctgcagaagcagctcaggccctatatggagtccatcgtgccgctccctggcatctatgacccggacttcatcgctgccaaccagggctcccgggctaacaatgtcatcaagggcacaaagaaagagcagatggagcaggtcatcaaagacataagggagttcaaggagaagaacaaggtagacaaggtagtggtgctctggacggcaaacactgaaaggtacagcaacgtctctgttgggcttaatgacacgactgagaacctcttggcgtctgtggacaagaacgaggctgagatatctccatcaacactgtatgccattgcctgtgtcatggagggtgtgccgttcatcaatgggagccctcagaacacctttgtgcctggactgattgatcttgctattaagaatgactgcctgattggtggcgatgatttcaagagtggccagaccaagatgaagtctgtcttggtcgacttccttgttggtgctggaatcaagcccacctcaattgtcagctacaaccatctggggaacaacgacgggatgaacctatccgcaccgcaaacatttcgttccaaggagatctcaaagagcaacgtggtggatgacatggtctcaagcaatgctatcctctatgagcccggggaacatcctgaccacgtcgtcgtgatcaagtacgtgccatacgttggagacagcaagagggccatggacgagtatacctcggagatcttcatggggggcaagagcaccatcgtgctgcacaacacctgcgaggactcgctcctcgccgcgccgatcattcttgatttggtgctcctggccgagctcagcaccaggattcagctgaaagccgagggagaggacaagttccattccttccatccggttgccaccatcctgagctacctcaccaaggcgcccctggtccctccaggcacaccggtggtgaacgcgctggcgaagcagagggcgatgctggagaacatcatgagggcgtgcgtcggcctggcgcccgagaacaacatgatcctggagtacaagtgaggagcacggccgacggaggccgaccgttacgttacgtacgtagcaagcggcgaggggcgacgggggagaagggcggggaggaagaaggaggcgagatcggccgtggaaccatttggcggttttgtctttggtttcctctgcgattctttccctggttaagctttacccttgtgtgttgtgtgtgtgtatgtccttgcgagactggttcggctctctgtccgggctctgctactactgtctggtgttgggtgatgtggagggaggagggtgcgtgttagcttaagttagcccgctccctctctgttcgtgttctgtaagttaactatatagtactggagtagtatggaagttgcgttcggtttaccgtcgtgttgtgtgctctgcttgttccggtcgtcaggacgcagc

SEQ ID NO: 567 - DNA, 1925 bp, Oat
cccccaccacaccagaccacagtcgaaagccgtccgtccctccttctcctccaccaccaagccggccggccagccagccaagatgttcatcgagagcttccgggtggagagcccgaacgtgcggtacggcgccggcgagatcgagtcggagtaccgctacgacaccacggagctggtgcacgagagccacaacggcgcatccaagtgggtcgtccgccccaagtccgtcaactaccacttcaagaccgacaccaacgtccccaagctcggggtgatgcttgtgggctggggcggcaacaatggctccacgctcatggctggcgtcatcgcaaacagggaggggatctcttgggcaaccaaggacaaggtgcagcaagccaactactttggctccctcacccaggcctccaccatcagggtcgggagctacaacggggaggagatttatgctcccttcaagagccttctgcccatggtcagcccagatgacattgtgttcgggggctgggacatcagcagcatgaacatggctgatgcaatgaccagggccaaggtgctcgacatcgaccttcagaagcagctcaggccgtacatggagtccattgttccacttcctggcatctatgacccagacttcatcgctgcaaaccaggggtcccgggccaacaacgtcatcaagggcaccaaaaaggagcagatggagcaggttattaaggatataagggagttcaaggagaagaacaaagtggacaaggtagttgtgctgtggactgcaaacactgagaggtacagtggagtctctgtcgggctaaatgacacgatggagaacctcttggcctctgtggacaagaacgaggcagagatctctccgtctacactgtatgccatcgcctgcgtcatggagggcgtaccattcatcaacgggagccctcagaacaccttcgtgccagggctgatcgatcttgcaatcaagaacaactgcctgattggtggtgatgatttcaagagtgggcagacgaagatgaagtctgtcttggttgacttccttgttggtgctggaatcaagcccacctcaattgtgagctacaaccatctggggaacaacgacgggatgaacttgtcggcaccgcagacattcaggtccaaggagatctccaagagcaacgtcgtagacgacatggtctcgagcaacgctatcctctacgagcccggggaacatcctgaccacgtcgttgtgatcaagtatgtgccgtacgttggagacagcaagagggccatggatgagtacacctcggagatcttcatggggggcaagagcaccatcgtgctgcacaacacctgcgaggactcactcctcgcggcacctatcatccttgacctggtgctcctggccgagctcagcacaaggattcagctcaaggcagagggagaggacaagttccactccttccacccggttgccaccatcctgagctacctcaccaaggcgcccctagttcctcctggcacaccggtggtgaatgctctggccaagcagagggccatgctagagaacatcatgagggcctgcgtcggcctggcgcccgagaacaacatgatcctcgagtacaagtgaagaggatcggagggcagagtcgccgcgctcatggtaacaagtgcgaatggatggacgggagggtaggaggaaggcgagattggctgtggaattatttggcttgtcttgtgtttcttttccgaattctttccctggttaagttacctttctgtgcttgcgagaaactctgtagtgtccgcctgtccgggctctgcaactagcagatgcttcttatggtttgtcggataatggtggtgttagcttagttagtctctgttagtaactttggtacttgaactttcagttaaggatgacttgtgctccgtgtttt

SEQ ID NO: 568 - DNA, 1923 bp, Oat
cacaacagaccagaccacagtcgaaagccgtccctccgtccctccttctcctccaccaccaagccggccagccagccaagatgttcatcgagagcttccgggtggagagcccgaacgtgcggtacggcgccggcgagatcgagtcggagtaccgctacgacaccacggagctggtgcacgagagccacaacggcgcctccaagtgggtcgtccgccccaagtccgtcaactaccacttcaagaccgacaccaacgtccccaagctcggtgtgatgcttgtgggctggggcggcaacaatggctccacgctcatggctggcgtcatcgccaacagggaggggatctcgtgggcaaccaaagacaaggtgcagcaagccaactactttggctccctcacccaggcctccaccatcagggtcgggagctacaacggggaggagatttatgcgcctttcaagagccttctgcccatggtcagcccagatgacattgtgttcgggggctgggacatcagcagcatgaacatggctgatgcaatgaccagggccaaggtgctggacatcgaccttcagaagcagctcaggccgtacatggagtccattgttccacttcctggcatctatgacccggacttcatcgctgcaaaccaggggtcccgggccaacaacgtcatcaagggaacgaagaaagagcagatggagcaggttatcaaggatataagggagttcaaggagaagaacaaagtggacaaggttgttgtgctgtggactgcaaacactgagaggtacagtggagtctctgtcgggctaaatgacacgatggagaacctcttggcctctgtggacaagaacgaggctgagatctctccatctaccctgtatgccattgcctgcgtcatggagggcgtaccgttcatcaacgggagccctcagaacaccttcgtgccagggctgatcgatcttgcaatcaagaacaactgcctgattggtggtgatgatttcaagagtgggcagacgaagatgaagtctgtcttggttgacttccttgttggtgctggaatcaagcccacctcaattgtgagctacaaccatctggggaacaacgacgggatgaacctgtcggcaccgcagacattcaggtccaaggagatctccaagagcaatgtcgtagacgacatggtctcgagcaacgctatcctgtacgagcccggggaacatcctgatcacgtcgttgtgatcaagtatgtgccctacgtcggagacagcaagagggccatggatgagtacacctcggagatcttcatggggggcaagagcaccatcgtgctgcacaacacctgcgaggactcgctcctcgccgcgccgatcatccttgacctggtgctcctggccgagctcagcacaaggattcagctcaaggcagagggagaggacaagttccactccttccacccggttgccaccatcctgagctacctcaccaaggcgcccctcgttcctcctggcacaccggtggtgaatgctctggccaagcagagggccatgctagagaacatcatgagggcctgcgtcggcctggcgcccgagaacaacatgatcctcgagtacaagtgaagaggatcggagggcagagtcgcggcagtcagcaagttgcgaatggatggatgggagggtaggaggaaggcgagattggctgtggaattatttggcttgtcttgtgtttcttttccgattctttccctggttaaagttacctttctgtgctttgcgagaaactctgtagtgtccgcctgtccgggctctgcaactagcagacgcttcttatggtttgtcggataatggtggtgttagcttagttagtctctgttagtaactttggtacttgaactttcagttaaggatgacttgtgctccgtgttttcca

SEQ ID NO: 569 - DNA, 2250 bp, Rice
cacaacgcacgaaccttctcagctctcaccggtggatagatagatgatactcctcgcctcgccgcttgcctcccccattgcgctcccaccggcggccggagtcgtctcccaatccgacccaaggtggggaccaccctcctgctcggtgggcccgagcagcccggccaagtggccgccgaaacccgctataaatcccccacgctccaccagcctccgattccacagcctacctagcttctccttctcgctcgcttcgcccgcataagtctagccacaaacccgccgccgccgccgccgccgccgccgctagcttccgcggagcggggcgagatgttcatcgagagcttccgcgtggagagcccgcacgtgcggtacggcgcggcggagatcgagtcggactaccagtacgacacgacggagctggtgcacgagagccacgacggcgcctcccgctggatcgtccgccccaagtccgtccgctacaacttccggaccaccaccaccgtccccaagctcggggtgatgctcgtggggtggggcggcaacaacggctcaacgctgacggctggggtcatcgccaacagggagggaatctcatgggcgaccaaggacaaggtgcagcaagccaactactatggctcactcacccaggcgtccaccatcagggtcgggagctacaacggggaggagatctacgcgcccttcaagagcctcctgcccatggtgaaccctgatgaccttgtgttcgggggctgggacattagcaacatgaacctggctgatgctatgaccagggcaaaggtacttgacattgatctgcagaagcagctcagaccttacatggagtccatggtgcctctccccggcatctatgaccccgacttcatcgccgccaaccagggatcccgcgcgaacaatgtcatcaagggcaccaagaaggagcagatggagcagatcatcaaggacatcagggagttcaaggaaaagagcaaagtggacaaggtggtggtgttgtggactgcaaacactgaaaggtacagcaatgtctgtgttgggctcaatgacacaatggagaacctcctggcgtctgtggacaagaacgaggcggagatatcaccatcgacactgtatgccattgcctgcgtcatggagggtataccgttcattaacgggagtcctcagaacacctttgtgcctgggctgatcgatcttgctattaagaacaactgcctgattggtggtgatgatttcaagagtggacagacaaagatgaagtctgtcttggttgatttcctagttggtgctggaataaagcccacctcaattgtcagctacaaccacttggggaataatgatggcatgaacctttccgcacctcaaacattccgatccaaggagatctccaagagcaatgtggtcgatgacatggtctcaagcaatgccatcctctatgagcttggcgagcatcctgatcatgttgttgtgatcaagtatgtgccgtatgttggagacagcaagagggcaatggacgagtacacctcagagatcttcatggggggtaagagcaccatcgttctgcacaacacctgtgaggactcactccttgccgcgccgatcattcttgatctggtgctccttgccgagctcagcaccaggattcagctgaaagccgagggggaggagaagttccattccttccatccagtggctaccatcctgagctacctcaccaaggcaccccttgttcctcctggcacaccagtggtgaacgccctggcaaagcagagggcaatgcttgagaacatcatgagggcctgcgttgggctggcccccgagaacaacatgatcctggagtacaagtgagggaggctgccgaggccgagcagccgtggcatgtggcaaagaggcgaatgggatggagcaagaaagacgtgattagctagctctaagaattgttttagcttctcttgtgatttttcggtctttcccattcttaaccttctgtgctttgtgtgagactcttatcgggctatgcaactagcagcagccttactatggtactggatgatgttatggagaatgttagctagttcccctctatttataacttattagtatcggagatttcagttcatcgctgactttgtgctgagcgttttattattttctcgccttgtaacataaccaattcccccttctctgttgtgtgctaaactgctaatccgcgaggcaaacaatgcaggaaactag

SEQ ID NO: 570 - DNA, 1763 bp, Silene
caaggtcgaaagccccaacgttgaatacagagatggtgaaattcactcggtttataattaccaaaccaccgagttggttcatgagaaccccaagggaaccggttatcagtggaccgttaagcccaagtccgtcaaatatgagttccggactcaaacccatgtccccaaactcggggtgatgcttgtaggatggggtggcaacaacggatgtaccctgacaggtggcgtcattgccaatcgcgagggaatctcatgggcaacgaaggacaaaattcagcaagccaactatttcggatccctcactcaggcttcttccattcgtgttggttccttcaatggagaggaaatctatgctccttttaagagccttcttcccatggttaacccagatgacattgtgtttgggggatgggacatcagcaacatgaacttagcagatgcaatgactagggctagagtcttggacattgatctgcagaagcaattgaggccttacatggagcacatggttcccctccctggtatttatgaccctgatttcattgcggctaatcaagattctcgtgccaataatatcattaagggcactaaaaaggaacaagttgatcaagtaattaaggacataagagagttcaaggagaagaccaaggtagacaaggtggtagtgttgtggacaggaaacacggagaggtatagcaacgtggtggtgggtctgaatgacactatagagaacttgttggcagctgtagatagggacgagtccgaaatttctccatcgacattgtatgcattggcttgtgttcttgaacaagtgcctttcatcaatggaagtcctcagaacacttttgttcctggcctcattgaccttgccattaagaacaatagtttgatcggaggtgatgacttcaagagtggtcagaccaagatcaaatctgtgcttgtcgacttccttgttggggccggtattaagccaacatctatagtgagctacaaccacttgggtaacaatgacggtatgaacctttcagcacctcagacttttaggtctaaagagatctctaagagtaatgtcgttgatgacatggttgcgagcaatggcattctgtttgagcctggtgaacaccctgatcatgttgtggtcattaagtacgtgccatatgtgggcgatagcaagagagctatggatgagtacacatctgagatattcatgggtggaacgaacactatagtcatgcacaacacatgcgaggactcacttttggcagctccaatcatcctcgacttagtcctccttgctgagcttagcactcgcatccagcttaagggcgaacacgaggacaagttccattctttccatccggtcgctactattctcagttacctcaccaaagctcctcttgttccaccagggactccagtggtaaatgcactctccaagcagagggcaatgctggaaaacattatgagggcttgtgttggtttggctcctgaaaacaacatgattctcgagtacaagtgagactgtggtgtgactgccctagctacaccgaggaattcggtaataaaatcgatccgagtcgaaagctctttcttccgtatttctcatcccgttctttgttttgtgttactgtgacccaaaggtgttgccgttgctgaaactgcgctttcttggttactttttagtgtcttcattatgagcagttttttccgcttagctgaagttgtaatcgtggaactatattaattaatgcaagtgttttgat

SEQ ID NO: 571 - DNA, 1826 bp, Tomato
taaaaatgtttattgagaactttaaggttgagagtcccaatgttaagtacacagagagtgagattcagtctgtttatgattatcaaacaactgatttggttcatgaggaaaaaaatgagacatttcaatggactgttaagccaaaaactgtcaaatatgaattcaaaactattgttcatgttccaaaatttgggtgtggttatgcttgttggatgggtggaaacaatggttcagccttgagtggaggtgttattgctaacagagaaggaatttcatgggctaccaaggatgtgcagcaagccaattactttggttctcttacacaggcctctactattcaagttgggtccttcaatgggcaggagatctatgcttcctttaagagcatacttcccatggttaatccatccagatgatgtagtgtttggagaatgggacatcagcaacatgaatttggcagatgacatggcaagagctaatgtttttgacattgatcttcaaaagaaactgaggccctacatggaatccatggtcccattccctggtatctatgaccctgatttcattacagcaaaccaaggctcacgtgctaacaatgtcatcaaaggaaccaagaaagaacaagttgatcaaattattaaggatattaggcagtttaaggagaacaacaaagtggacaaggtggtggtcctgtggactgccaacactgaaagatacagcagtgtggttgttggccttaatgataccatggaaaacctctttgcttctgtggatagaaatgaggccgaaatatctccttccaccttgtatgctattgcttgtattcttgaaaatgtacccttcatcaatggaagcccacaaaatacttttgtcccaggcctcattgatttggccatcaagaggaacactttgattggtggtgatgactttaagagtggtcaaaccaagatgaagtcagtgctggtttatttccttgttggagctggtattaaccaacatcaatcgtgagctacaaccatttgggtaacactgatggaatgaatctgtctgcccctcaaactttctgttcaaaggagatctcgaaaagcaacgttgtcgatgacatggtttctagtaatgccatcctttatgagcctggagagcaccctgaccatgttgttgtgattaagtatgtaccatatgtgggagatagcaagagggcaatggatgagtacacatcagagattttcatgggtggaaggaacactattgtattgcacaatacctgtgaggattctcttttggctgctccaattatcttggatttagtcctcctggctgaaatcagcatccgcattcagctcaaagctgaaggagagggtaagttccactccttccatcccgtcgcgaccatcctcacttatcttacaaaggctcctctggtaccaccaggtacaccaatggtgattgccctttcaaagcagagggcaatgcttgagaacatattgagggcttgtgttggactggcactagagaacaacatgatcttggaatacaaatgaaaatctcataagaagtgaaaggactcaagaagttgtgtagcagaaaaaccatgttgtctttctttacttttatttttgtaatcttttcttatcattagtacaaggtaattagctaaatctcaaccaacccttggaggtatagttgttgtttgatgatgggctaagttgaacatcattatgatttccttgttgtcttttagtattagcccttcatttttaagatgtattatcagtgttttcttagctctttagagccagcaacgcctttctctacctttctctacc

SEQ ID NO: 572 - DNA, 2315 bp, Maize
attatgatagcaggtatccattgtcatcgctcagtcacagaggcagccactgccgacgggcgacggccgacggcctcccatttcgatcccctcctactcctatgctgcggtccagcataagttcgggacttccggcaatccgccggcgcccgtcggctcaaatcgcatctaccgcggctagaagctctctcttcctccctccgatccggtggggtccatttccttcaattgtggcagtggccgtctcgaaccctctataaatcccccaccccggacacccttccccgaccacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgcggtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccaccatcagagtaggcagctacaacggggaggagatatatgcgccgttcaagagcctcctacccatggtgaacccagacgaccttgtgtttggaggctgggacatcagcagcatgaacctggcagatgccatgaccagggccaaggtgctggacattgacctgcagaagcagctcaggccctacatggagtccatggtgccacttcccggtgtctatgatccggacttcatcgccgctaaccagggctctcgtgccaacaatgtcatcaagggcaccaagaaagaacaggtggagcagatcatcaaagatatcagggagtttaaggagaagaacaaagtggacaaggtagttgtgctgtggactgcaaacactgaaaggtacagcaatgtatgtgctggtctcaacgacacaatggagaatctgctggcatctgtggacaagaacgaggcggagatctcgccatcaacactatatgccattgcctgtgtcacggagggggtgccgttcatcaatgggagcccccagaacacttttgtgcctgggctgattgatcttgctatcaagaacaactgcctgatcggtggtgacgacttcaagagtgggcagaccaagatgaaatcggtcctggttgattttcttgttggtgctggaataaagcccacctcgattgtgagctacaaccacttgggaaacaacgacggcatgaacctgtctgcccctcaaacattcaggtccaaggagatctccaagagcaacgtggtggatgacatggtctcaagcaatgccattctctatgggcccggcgagcatcccgatcatgttgttgtcatcaagtatgtgccgtatgtgggagacagtaagagggctatggacgagtacacatcagagatcttcatgggcggcaagagcaccatcgtgctgcacaacacctgcgaggactcgctcctcgccgcaccgatcatcctcgatctggtgctcctggctgagctcagcaccaggatccagctaaaacctgagggaacggacaagttccactccttccacccggtggccaccatccttagctacctcaccaaggcaccactggttccacccggcacaccggtggtgaacgctcttgcaaagcagagggcgatgctggagaacatcatgagggcctgcgttggcctggccccagagaacaacatgatcctggagtacaagtgagcgaagtggcgtggcctgcagctagatatggaggaggctgcacgaaggggactagagaggcgagattagctgtggaattgtgttggcttctcgtgttttcttttgcgttcttttcctggtcatcgctgtggcgcttttgtattttatttgttggacccgtaacactatcagggctctgctattagcgcttgaagcctgtaatggcattggcatcgtatgataatgtgatcgagggtgctagttcccctaagcattatttatataagttcaaatggcggcccggcccggtccggcctgagcctgagcccgctgtggcctggcacgaattgggacaggcccgttacgtcaca

SEQ ID NO: 573 - DNA, 2017 bp, Oat
accccacccatccccccaccacaccagaccacagtcgaaagccgtccgtccctccttctcctccaccaccaagccggccggccagccagccaagatgttcatcgagagcttccgggtggagagcccgaacgtgcggtacggcgccggcgagatcgagtcggagtaccgctacgacaccacggagctggtgcacgagagccacaacggcgcatccaagtgggtcgtccgccccaagtccgtcaactaccacttcaagaccgacaccaacgtccccaagctcggggtgatgcttgtgggctggggcggcaacaatggctccacgctcatggctggcgtcatcgccaacagggaggggatctcgtgggcaacaaaggacaaggtgcagcaagccaactactttggctccctcacccaggcctccaccatcagggtcgggagctacaacggggaggagatttatgcgcccttcaagagccttctgcccatggtcagcccagatgacattgtgttcgggggctgggacatcagcagcatgaacatggccgatgcaatgaccagggccaaggtgctggatatcgatcttcagaagcagctcaggccgtacatggagtccattgttccacttcctggcatctatgacccggacttcatcgctgcaaaccaggggtcccgggccaacaacgtcatcaagggcaccaaaaaggagcagatggagcaggttattaaggatataagggaattcaaggagaagaacaaagtggacaaggtagttgtgctgtggaccgcaaacactgagaggtacagcggtgtctctgtcgggcttaatgacacgatggagaacctcttggcctctgtggagaagaacgaggctgagatctctccatctaccctgtatgccatcgcttgcgtcatggagggcgtaccgttcatcaatgggagccctcagaacaccttcgtgccagggctgatcgatcttgcaatcaagaacaactgcctgattggtggtgatgatttcaagagtgggcagacgaagatgaagtctgtcttggttgacttccttgttggtgctggaatcaagcccacctcaattgtgagctacaaccatctggggaacaacgacgggatgaacctgtcggcaccgcagacattcaggtccaaggagatctccaagagcaacgtcgtagacgacatggtctcgagcaacgctatcctctacgagcccggggaacatcctgatcacgtcgttgtgatcaagtatgtgccctacgttggagacagcaagagggccatggatgagtacacctcggagatcttcatggggggcaagagcaccatcgttctgcacaacacctgcgaggactcgctcctcgccgcaccgatcatccttgacctggtgctcctggccgagctcagcacaaggattcagctcaaggcagagggagaggacaagttccactccttccacccggttgccaccatcctgagctacctcaccaaggcgcccctcgttcctcctggcacaccggtggtgaatgctctggccaagcagagggccatgctagagaacatcatgagggcctgcgtcggcctggcgcccgagaacaacatgatcctcgagtacaagtgaagaggatcggaggccagagtcgccgcgctcatggtaacaagtgcgaatggatggacgggagggtaggaggaaggcgagattggctgtggaattatttggcttgtcttgtgtttcttttccgaattctttccctggttaagttacctttctgtgcttgcgagaaactctgtagtgtccgcctgtccgggctctgcaactagcagacgcttcttatggtttgtcggataatggtggtgttagcttagttagtctctgttagtaactttggtacttgaactttcagttaaggatgacttgtgctccgtgttttccatattggtctctcttatcgttggttgacgaagttcgcaatcaaggagaatctggcttcatagcctagtgaactccacc

SEQ ID NO: 574 - DNA, 2051 bp, Rye
tcacacacaattcactccagcccccctgccaccgcactcgagaccctctctctctcgctccaacagtctccgggaaagagagagagggagagagatcgatcttgcgttgccaagatgttcatcgagagcttccgcgtggagagcccgaacgtgcggtacggcgcgggggagatcgagtccgagtaccgctacgacaccacggagctggtgcacgagagccacgacggcgcctccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggcgaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgactagggccaaggttttggacattgacctgcagaagcagctgaggccctacatggagtccatcacgccgctccccggcatctatgacccggacttcatcgctgccaaccagggctcccgggctaacaatgtccttaagggtacaaagaaagagcagatggagcagattatcaaagacattagggagttcaaggagaagaacaaggtggacaaagtagtggtgctttggacggcaaacactgaaaggtacagcaacgtctctgttgggcttaatgacacgatggagaacctcttggcgtctgtggacaagaacgaggcagagatatccccatcaacactgtatgccatcgcctgcgtcatggagggtgtgccgttcatcaacggagcctcagaccactttgtgcctgggctgatcgatcttgctattaagaacaactgcctgattggtggcgatgatttcaagagtggtcagaccaagatgaaatctgtcttggttgacttccttgttggagctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccacgtcgtcgtgatcaagtatgtgccatatgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggagaggacaagttccattccttccacccggttgcgaccatcctgagctacctcaccaaggcacccctggttcctcctggcacgccggtggtgaacgccctggcgaagcagagggcgatgctggagaacatcatgagggcgtgcgtcggcctggcgcccgagaacaacatgatcctggagtacaagtgaggagcaccgcccaagctcgcggagccgagagagaccgtacgtacgtagcaagtggcgaggggcgacgggagggctggaggaagaagaaggcgagatcggctgtggaattatttggcggcttgtctttagtttcctttgcgattctttccctggttaagtttaccctagtgtgtatgtgtgtgtctccttgcgagactatttcggctctttgcgacatggtagcttctcatggactccatggtgttggatgatgtggagggaggagggtgcgtgctagcttaaagttagtccactccctctgttcgtgttttgtaagttaattagtaatatgtgtactactagtatatggaactttcaatcggtagaacaaaaaaaaaaaaaaaactagagactgtccgaacgacgac

SEQ ID NO: 575 - DNA, 1823 bp, Bean
aaaccagcgggcgccagtgtgagtaatttagcaaaaccgatccaaattccgagaaagacaaccacttttccttttcctctgcaaaaatgtttattgagagcttcaaagttgagagcccgaacgtgaagtacacagagaatgagattcactctgtgtacgattacgagacgacggaggttgttcatgagaagaccgtcaatggcacttaccaatggattgtgaagccaaagactgtcaaatacgatttcaaaaccgatattcgtgtccccaaattaggggttatgcttgtgggtttgggaggaaacaatggatcaactctcaccgctggcgtgattgcgaacaaagaaggaatctcgtgggcaacgaaggacaaagtgcaacaagcgaattacttcgggtcactaactcaagcttcatcgattcgtgtcggatcttttaacggtgaagagatctatgctcctttcaagagtctccttccaatggtgaatccggatgatgttgtgtttggaggatgggatataagtgacatgaacttagcagatgccatggctagagccagggttcttgatatcgacttgcagaaacagctcaggccttacatggagaacattgtgccactccctgggatcttcgatcctgatttcatagctgctaatcaagggtcacgtgctaaccacgtgatcaaaggtaccaagaaggaacaagtcgaccacatcatcaaggacatgagggagtttaaggagaagaataaggtggataaggttgtggttctctggacggctaacacagagcgttatagcaatgaggtcgttgggatgaacgatacaatggaggatctcatggagtctgtggatagggatgaggctgagatctctccttcaacactttatgcgattgcttgtgttcttgagggaatcccgttcatcaatggaagccctcaacacacctttgttccaggtctaattgatatggcgatcaggaacaatgttttgatcggtggagatgatttcaagagtggtcaaaccaagatgaaatctgtcttgggtgatttcctagttggcgcaggaatcaagcctacttcaattgtgagctacaatcacttgggcaacaacgatggaatgaatctctcagctccacagactttcagatctaaggagatctcgaaaagcaatgtcgtggacgatatggtcgctagcaatggtatcctctttgagcctggggaacacccggaccatgttgttgtcatcaagtatgtaccgtatgttgcggatagtaagcgagccatggacgagtacacatcagagatattcatgggagggaagaacacaattgtgatgcacaatacctgcgaggactctctcttagctgctccaatcatcttggatcttgttctcctcgcggagctcagcaccaggatccagttcaaatccgagggagagggaaagtttcactctttccatcctgtggccaccatactcagctacctcaccaaggcaccacttgtaccgccaggaactccggtgattaacgcactgtcgaagcagcgggctatgctggagaatattatgagggcgtgcgttggactggctccggagaacaacatgatcatggaattcaagtgaacatgaagaagcatgaatctaagacctttaattagctcataatttaagagtctttaatttgttcgttgtttggtttttatataatgtttttaaattatgaaagcttgtgtttctgagagaccaaagagcttttagtttggtctctgtagggtgtgaagtaacttgtatttgtagtaatccggatgggttggtatattttgc

SEQ ID NO: 576 - DNA, 1535 bp, Eschscholzia
agagagagaaagtaagattaattttggtgaaaatgtttattgacaatttcaaggttgagagcccaaatgtgaagtattcagaaaatgagattcactctgtttacaattatgaaactacagaacttgttcatgagaacaaaaatggtgcttatcaatggactgtcaaacccaagactgttaaatatgaattcaagacagagaccaaggtccctaaacttggggttatgcttgttggatggggaggaaataatggttcatctcttactggtggtttaattgcaaacagagaaggaatctcttgggctaccaaagataaagtacaacaagctaactattttggttcattaactcaagcttcaacaattagagttggatcttttaatggtgaagaaatttatgctccatttaagagcctacttcctttggtgaaccctgatgatattgtattaggaggatgggacataagtgacatgaacttggcagatgccatggcaagagctaaagtttttgacatagatttgcagaagcaattaagaccatacatggaatcaatggttcctcttcctggaatttatgatcctgatttcattgctgcaaatcaaggatctagagctaacaatataatcaaaggaacaaagaaagaacaagttgaacaaatcatgaaagacattagggagtttaaggagaatagcaaggtggataaagtggtagtactttggactgcaaacacagaaagatacagtaatgtgattgttggactaaatgataatattgagaatcttttgggttctttggaaagaaatgagtctgagatttctccttcaactttgtttgctttggcttgtatttatgaaaatgttcctttcatcaatgggagcccacagaacacctttgttccagggttgattgatttggctatgaagcataacactttgataggaggagatgatttcaagagtggtcaaactaagatgaaatctgtattggttgatttccttgtgggggctggaatcaagccaacttcaattgtaagctacaaccatctcggaaacaacgacgggatgaatctcagtgcgcctcaaacttttcgatcaaaggagatctcaaaaagtaatgtcgtcgatgacatggtttcaagcaatggtattctgtatgaagctggagagcatcctgaccatgtcattgtaatcaagtatgtgccatatgttggggacagtaagagagcaatggatgaatatacctcagagatattcatgggtggaaaaagtactattgttatgcataatacatgtgaagattcacttttggctgctccaattattttggatttagtccttcttgccgagctcagcacacgaatccaactcaaatctgagggagaggagaagtttcattctttccatccggttgcaaccatcctcagctatctcaccaaggctccacttgtaccaccagggacaccagtggtgaatgcactatcaaagcagagagcaatgctagagaacataatgagggcatgtgttggtttggctcct

SEQ ID NO: 577 - DNA, 1529 bp, Lolium
atgttcatcgagagcttccgtgtggagagccccaacgtgcggtacggcgccggcgagatccagtcggagtaccgctacgacaccaccgagctcgtgcacgagagccacaacggcgcatccaagtgggtcgtccgccccaagtccgtcggataccagttcaggaccgacaccaatgtccccaagctcggggtgatgcttgtgggcttgggcggcaacaatggctccacactcatggctggtgtcatcgccaacagggaggggatctcatgggcgaccaaggacaaggtgcagcaagccaactacttcggctccctcacccaggcctccaccatcagggtgggaagctacaacggagaggagatctatgcgcccttcaagagcctcctgcccatggtgagcccagatgacatcgtgttcggaggctgggacatcagcagcatgaacatggctgatgctatgaccagggccaaggtgttggacattgacctgcagaagcagcttaggccctacatggagtccatcgttccacttcctggtatctatgacccggacttcatcgctgccaaccaggggtcccgggccaacaatgtcatcaagggcaccaagaaagagcagatgcagcagatcatcaaggacatcagggagttcaaggagaagaacaaggtggacaaggtagttgtgctctggactgctaacactgaaaggtacagtgctgtctctgttgggcttaatgacacgaccgagaacctcttggcgtctgtggagaagaacgaagcagagatctctccatcaacactatatgccatcgcttgcgtcatggagggcgtgcctttcgtcaacgggagccctcagaacaccttcgtgcctgggctgatcgatcttgctatcaagaacaactgcctgattggtggtgatgatttcaagagtggccagaccaagatgaagtctgtcttggttgacttccttgttggcgctggcatcaagcccacgtccattgtcagctacaaccatctggggaacaacgatggcatgaacctatctgcaccacagacattcaggtccaaggagatctccaagagcaacgtggtggatgacatggtctcgagcaatgccatcctctttgagcccggggaacatcctgatcacgtcgttgtgatcaagtatgtgccgtacgttggagacagcaagagggccatggatgagtacacctcggagatcttcatggggggtaaaagcaccatcgtactgcacaacacctgcgaggactcgctccttgctgcaccgatcatccttgacctggtgctcctggccgagctcagcacaaggattcagctcaagtcagagggagaggacaagttccactccttccacccagttgctaccatcctgagctacctcaccaaggcacccctcgtccctcctggcacaccggtggtgaacgctctggcgaagcagagggccatgctcgagaacatcatgagggcctgcgtcggcctggcacctgagaacaacatgatcctggagtacct

SEQ ID NO: 578 - DNA, 1702 bp, Tobacco
ttatcaaaccacagagcttgttcatgaagagaaaaatggttcttatcaatggactgtcaagccaaaatgtgtcaaatatgagttcaaaactgataccaatgttcccaaattaggggttatgcttgttggatggggaggaaacaatggttcaactttgacaggaggtattattgctaataaagaaggaatttcatgggcaacaaaagagaaggtgcaacaagccaattactttgggtctcttactcaggcatcaacaattagagttggatctttcaatggagaagagatctatgcccctttcaagagcctccttcccatggttaatccagatgatgtagtatttggaggatgggacattagcaacatgaatttggcagatgctatggtcagggctaaggttttcgacattgatctgcaaaaccagctgaggccatacatggaatcaatggtcccccttcccggtatctatgaccctgacttcattgctgctaaccaagaatcacgcgccaacaacgtgatcaaaggaaccaagaaagaacaagttgatcaaattgttaaagatattagggagttcaaggagaagaataaggtagacaagattgtggtgctgtggacagccaacactgaaagatacagcaatgtgattgtaggacttaatgacacaatggaaaaccttttggctgctgtggatagagatgaagctgaaatatctccttctacattgtatgctattgcttgtgttcttgaaaatgtrcctttyatcaatggaagyccacaraacacttttgtmccaggtctwattgatttggccataaagaggaacactttgattggtggtgatgactttaagagtggtcaaaccaagatgaagtcagtgctggttgatttcctagttggagctggtattaagccaacatcaattgtgagctacaatcacttgggtaataacgatggaatgaatctttctgcccctcaaactttccggtctaaggagatctcaaaaagcaatgttgtcgatgacatggtttccagtaacgccattctctatgaagctggcgagcatcctgaccatgttgttgtgatcaagtatgttccatatgttggagatagtaagagggcaatggatgagtacacatcagagattttcatgggtggaaataacactatagttttgcacaacacttgtgaggattctcttttggctgctccaattatattggacttagtccttctcgccgaactcagcactcgcattcagctcaaagctgaaggagaggggaagttccactctttccatcctgttgctactatactcagctacctcactaaggctcctttggtaccaccaggtacaccagtggtgaatgctttgtcaaagcaaagggcaatgcttgagaacatattgagagcttgtgttggtttggcaccagaaaacaacatgattttggaatacaaatgaaatatccaaataaaggaaactaatagaagagaatggactcaagagtagttgcatgttctctcttctctttccttttctattttctcatcattatataattaagcaaagtttggcatgactttgacatacagatgattgaagggccaaatctctatgttaccataatacaatgtggtggtttggattttctattggaaatacaatgtggtgatttagatttcgttttagtaaatctactttgcc

SEQ ID NO: 579 - DNA, 1887 bp, Ginger
gagaacgaggaggaggaagcggctgcttcgctgatcagattgggaagatgtttgtggagaagtttagagtggagagccccaacgtgaggtatggggaggaggagatcgaggcggtgtaccactacgagacgacggatctggtgcacgagagccgggacggtgcttaccaatggatcgtacgccccaagagagtccgatacgacttcaagacccaaacccgcgtccccaagcttggtgtgatgctcgtgggatggggtgggaacaacggttctaccctcaccgccggagttatcgccaaccgagagggcatctcttgggtaaccaaggacaaggtgcagcaggccgactattttggatcgctgacccaggcttctaccatcagggttggctcctacaatggggaggaaatctatgcccctttcaagagtctccttcctatggttaatccagatgatatagtgttcggtggatgggatattagtaacatgaacatggcagatgccatgggcagagccaaggtcctggacatagacctgcagaagcagcttaggccctacatggagtccatggtccccttgcctggaatcttcgaacccgactttgttgcggcaaaccaaggtgcccgggccaacaatgtcatcaagggaaccaagtcggagcaagtccaacaaatcatcaaggatataagggaatttaaggagcagactcaggtggataaagtggttgtgctgtggacagccaacacagagaggtatagcaacgtgattgttggtctcaacgacaccatggagaatctcatggcctcacttgagaagaatgaaaccgagatatctccttccacattgtatggtatagcgtgtgttctggagaatgttccttacattaacgggagtccgcaaaatacctttgtgcctgggctcattgagatggccattcaaagaaacagtcttataggaggagatgacttcaagagtgggcagaccaaaatgaaatctgtcttagttgaatttttggtcggggcaggaatcaagccaacatctattgttagctacaaccatctgggaaataatgatgggatgaacctatctgccccacaaaccttccgatccaaggagatctcaaagagcaatgtagttgacgacatggtctccagtaatggcatcctttatgagcccggggagcaccctgatcatgtcattgtcatcaagtatgtaccatatgttggtgacagcaagagggctatggacgaatacacgtctgagatattcatgggtggacggagcactatagttcttcacaacacctgcgaggattccctgttggcagctcccataattttggatcttgtcttgcttgctgaactgagtactaggattcagcttaaggaggagggagaaggcaaattccactctttccatccagtctctgcaatcctcagttaccttaccaaagctccacttgttcctccaagcacaccggtggtgaatgctctggcgaagcagagggccatgctggagaacatactcagggcttgcgttggcctggctcctgagaacaacatgaacctggagtacaagtgaaacaaagcatatagagagcgaggggaaagtgatcaaagaaaagttcagaaaggtgtctctttagctggtttttcgtgtctatgccttggtcgtcatctcctcctctcaggcaacagtgagagtagtgcctctcaaggcaagagctcaatttatggggcttctaatatatataacaataataatgactcgcgtgttttcgttgtgaagtgtgatggtggatcttaaatcataattctaaagtttgaatgtctcctgcttattttaatcataatttytggcttgtccctyktscygaattcggcacgag

SEQ ID NO: 580 - DNA, 2028 bp, Taxus
aacgaaagatagccgcatttggagcagagtttagcggagtctttggctactagacaaaatatcggcctgcctgccttctcgccatcagtttagcagaaagctgatttttcgcctgctgaaatttcattgaaggcgaatctcaaaaatcgaaaccccgtgtccttatcattcatacctgcattgtcgaattttgctgcattttgtttccaaaaatcaaagcttttttgtccgccattaaagctagctgcgttttgtgacctgagctttgtttgaagatgtttatcgagagcttccgcgtgcagagccccaatgtgaaatatacggaggaaagcatcgactcggtttatgactatgaaacgaccgagctcgtgcatgagaacacaaatggtaagtatgagtgggtcgtgaagcccaagaccgttaagtatgatttcaaaactgatacgcgggtccctaagctcggggttatgctggttggatggggagggaacaatggctgtaccctgaccgctggtgttattgccaatagagagggaatttcatgggtgacgaaggataaagtacagcaggcgaattactttggatctctcacccaggcatcgacatgcaggatcggatcctttaatggcgaggaaatttacgcgcctttcaagagccttcttcccatggtggaccctaacgatatcgtgtttggcggatgggacataagcaacatgaacttggctgacgccatggccagagcgaaggtgctcgaagttgatttgcagatgcagctccggccctacatgcaagatatggtgcctcttcccggaatcttcgacccggacttcatagccgctaaccaaggcgaaagggcaaataatattatcaagggttccaagaaggaacaagttcagcaaataattcaggacataagggaattcaaggcgaaaacaaaggtcgagaaaattgtcgtcctctggaccgctaacacggaacgatacagcgacgttattgtagggctgaacgatacaaaggagacactttttgcatctctggagaaaaacgagtctgagatctctccatcgaccctttacgctatagcttgtgtgcaggagaacattccctttatcaatggcagtcctcaaaatacgtttgtcccaggtctgatcgactttgccatcgaaaagaacagtcttattggaggagatgacttcaagagtggacagacaaagatgaagtccgtgcttgtggactttctggttggtgctggtatcaagccaactgcaattgtgagctacaaccatttgggaaacaacgacgggatgaatctgtcagctccgcagactttccgttccaaggaaatttccaagagcaatgttgtagacgacatggtgtcgagcaacgcaattctgtatgggcctggcgaacatcctgaccatgtcgtcgtcatcaagtacgtgccatacgtgggagatagtaagagagccatggacgaatatacatcggagatcttcatgggaggaaagagcaccatcgtccttcacaatacttgcgaggactctctacttgcagctcctctcatcttggatttggtcttacttgctgaacttagcaccaggatccagctcaagaaagagggcgaggcgaaattccactcttttcaccctgtagcaactattctgagctacctcacgaaagcgccgctggtgccacctggcacgccaatagtgaatgcgctggcgaagcagagggccatgctggagaacataatgagggcatgcgttggactggctccagagaacaacatgatcctcgagtacaagtgaaaggctggcgcccagtcggctttcacatggggcccacgattgtctctcttttaatttgtgtgtttttatgtctctaggtagtgtgttgtggttgagggccgcacgtataaagaaggcggctctttcaccattttctcttttctattgtaaaatttgcgtgacctttgtccgttttcaatcttcagtgttttatttaagtgactaagtagatgtgaaatat

SEQ ID NO: 581 - DNA, 1690 bp, Momordica
accacggaacttatccatgagaataagaacggtagctatcagtggacagtcaagcccaagattgtcaaatacgaattcaagactgatacccgcctcccaaaactaggggttatgcttgttggatggggtggaaacaatggttcaacccttactgggggtgttattgccaatcgagaaggaatctcctgggcaactaaggataaagttcaaccagccaactattttggctcattgacccaggcttcgtctatccgcgtgggttcttacaatggcgaggagatatatgccccatttaaaagcctcctacctatggttaatccagatgacattgtgtttggagggtgggacattagcgacatgagcttggcagatgccatggcaagggccaaggtgtttgatattgacctgcaaaagcaattgaggccctacatggaatccatggtcccgctccctgggatctatgaccctgattttatagccgctaatcaagattccagagccaacaatgtgatcaaaggaaccaagaaagaacaagtccaaaaagtcataaatgatatcaaggagtttaaggagaagagtaaagtggataaagtggttgtgctttggactgccaacacagagaggtacagcaatgtggttgtggggctgaatgacacaatggagagccttttagcttcactggacaaaaacgaggctgaaatatctccttctaccttatatgcaattgcctgtgttcttgaaaatgtcccttttatcaacggaagcccacagaacaccttcgtccctgggttgattgatttggctattagaaggaacagtttgattggaggagatgactttaagagtggtcaaaccaagatgaaatctgtcctagtggattttctagtcggggctggtatcaagccaacttcaattgtgagctacaaccatcttggaaacaatgatggaatgaatctctctgccccacaaaccttccgctccaaagaaatatcaaagagcaatgtggtggacgacatggtgtcgagcaatggcatcttgtacgaaccaggggagcatcctgaccatattgtggtgatcaagtatgtaccatacgttggagacagcaagagagccatggatgagtacacatcagagatattcatgggtgggaagagcaccatagtgctgcacaacacatgcgaggactcccttttggccgctcccattatccttgatctagttctgcttgctgagctcagttctcgcatccagctcaaggctggaggagaggagaagtttcattcattccatccagtggctacaatactgagctatctcaccaaggctcctcttgttcccccaggcacaccagtggtgaatgccctgtcgaagcaaagggcgatgttggagaacattttgagggcatgtgttgggctggcgcctgagaataatatgatcttggaatacaagtgaaaaatgccacttctgctttcctagtttcagttcgatgtaattgatgctcttgtctcagcaatgtgcattttatttttcttttttagagcaggaagcttctgtgtgaaggctgttgtcttgtgattcaacagcatcccttaatgaggaaaggggagtatgatatataattaacgggttaaactactctcagtgtgcaagttaacggtacattttcaatataaacttgtggacgtttcga

SEQ ID NO: 582 - DNA, 2020 bp, Podocarpus
cagagcaagtcttgttgattcttcttcaaccttcgctttttgctgtgtgtgaaaatgtttattgagagctttcgtgttcagagcccaaatgttaagtacagtgaggagagtattgaatcggtatatgattatgaaactactgagcttgttcacgagaacagaaatgggaagtatgagtgggtcgtcaagcctaagactgtaaaatacgagttcaagactcagacgcgggtcccgaagttaggggttatgttggtaggatggggagggaacaacggctgcacgcttacagcaggcgttattgcgaacagagaggggatttcttgggttacaaaggagaaagtgcagcaggcgaactactttggctctctcacgcaagcgtccacctgcagaattggatcctacaatggcgaagaaatttacgctcctttcaagagccttcttcccatggtggatccgaacgatatcgtgtttggcggatgggatattagcaacatgaacttggcagatgccatggctcgagccaaggttctggacattgatctccagaagcagctcaggccctacatgcaagacatgatgccacttcctggcatcttcgatccggatttcatcgccgcaaaccaaggcgaacgagccaataacatcatcaagggttccaagaaggaacaagtgcacaaaatcattcaagacattagagaattcaaggcgaaaacgaaggtagataaggtagttgtgctctggaccgcaaataccgaacgatacagcgacgttatagtgggcctaaatgacacaaaggaaacttttctcgcttctcttgaaaggaacgagtcggagatctcgccgtccagtctttacgccctggcttgtatagaggagaacgttccgttcatcaacggcagtcctcagaacacgtttgtcccaggtcttattgatttggccattgagaagaacagtctgataggaggtgatgacttcaaaagcggacagacaaagatgaagtccgtgctggtggatttcctggtcggtgctggcatcaagccaactgcaatagtgagctacaaccatctgggaaacaacgatgggatgaatctgtcagccccacagaccttccgctccaaggagatttccaagagcaacgttgtcgatgacatggtttcgagcaacgccatcttgtatggacctggcgaacatcccgaccatgtcgttgtcatcaagtatgtgccttatgtgggagacagcaaaagagccatggacgaatacacatcagagatattcatgggagggaagagcaccatcgtacttcacaacacttgtgaagactctctccttgcagcacctctcatcctggacttggtcttactcgcagaactcagcaccaggatccagctcaagaaagagggcgaggagaaattccactcctttcaccctgtggcaacgattctgagctacctcaccaaagccccactggtgccacctggcacgcctgtggtgaatgccctggcgaagcagagggccatgctggagaacatcatgagggcatgcgtggggctggctcccgagaacaacatgatactggagtacaagtgagggaagggctggcgcacagtcggcctacatgtggcactgctgcttccacgggcataatgcacaaaccgcctgtctagtccttgtcttactgttcaacctgtggtggtgtcaataattgtcctttcttgttttgtattgtaaaattgtaatgttgtgtctaattgaaaaataattttctttgtccgatggaagtggactgtctgggtaatggagaaggcagtgtaagtgatggggatatgcatatattattggaatgtatttatttttaagcatcgctgtcaaaaggtatgcaacgaattttatatataatgtcggtttggggccttggcgtatccaaggggacgcttgtcatgtgagagtaattaattagttatcaacagtaaatcagaagttttaattaacaattatgaatggaaagtgaatatagtaaagt

SEQ ID NO: 583 - DNA, 1833 bp, Curcuma
gcaccaggcctcgtgccgaattcggcacgaggggagaacgaggaggaggaagcggcggcttcgctgatcagattgggaagatgtttgtggagaagtttagagtggagagccccaacgtgaggtatggggaggaggagatcgagtcggtgtactactacgacacgacggatctggtgcacgagagccgggacggtgcctaccaatggatcgtacgcccgaagagagtccgatatgatttcaagacccagactcgcgtccccaagctcggtgtgatgctcgtgggatggggtgggaacaacggttccaccctcaccgccggagttattgccaaccgagagggcatctcttgggtaaccaaggacaaggtgcagcaggccgactattttggatctctgacccaggcttctaccatcagggttggctcctacaatggggaggaaatttatgcccctttcaagagtctccttcctatggttaatccagatgatatagtgttcggtggatgggatattagtaacatgaacatggcagatgccatgggcagagccaaggtcctggacatagacctgcagaagcagcttaagccctacatggagtccatggtccccttgcctggaatcttcgaacccgactttgttgcggcaaaccaaggtgcccgggccaacaatgtcatcaaaggaaccaaatcggagcaagtccaacaaatcatcaaggatataagggaatttaaggagcagactaaggtggataaagtggttgtgctgtggacagccaacacacagaggtatagcaacgagattgatggtctcaacgacaccatggagaatctcatggcctcactcgaaaagaatgaaaccgagatatctccttccacattgtatggcatagcgtgtgttctggagaatgttccttacatcaacgggagtccacaaaataccttcgtgccggggctcattgagatggccattcaaagaaacagtcttataggaggggatgacttcaagagtgggcagaccaaaatgaaatccgtcttagttgatttcttggtcggggcaggaatcaagccaacatctattgttagctacaatcatctgggaaacaatgatgggatgaacctatctgccccacaaaccttccgatccaaggagatctcaaagagcaatgtcgtcgatgacatggtctcgagtaatggcatcctctatgagcccggggagcaccctgatcatgtcattgtcatcaagtatgtaccatatgttggtgacagcaagagggctatggacgaatacacgtctgagatattcatgggtggacggagcactatcgttcttcacaacacctgcgaggattccctgttggcagctcccataattttggatctagtcctgcttgctgaactgagtactaggattcagcttaaggaggagggagaaggcaaattccactctttccatccagtctctgcaatcctcagctaccttaccaaagctcccctcgttccccccggcacaccggtggtgaatgctctggcgaagcagagggccatgctggagaacatactcagggcttgcgttggcctggctcctgagaacaacatgaacctggagtacaagtgaaacaaagcatatggagactgggggaaaatgggaatgggcgaggaaatgttaggcattcatctcctcccctctcatgcatcactgagagtagtgtatctgcctctgcctctcagggcaagagctcagtttaaatctatcaatctatatatatataatgaatagggtgttttaaaggtgtagtgtgatggtggatcgtaaatcatactttaaagttgagggg

SEQ ID NO: 584 - DNA, 2040 bp, Sciadopitys
gcagcagcgagcaagcgagcgatcgatttgccttttcctgcagttttctgaatttaagtttggttgcatttgggaagatgtttattgagaagttccgcgtgcagagccccaatgttaagtacacagaggagagtattgagtctgtgtatgactattctaccacggagcttgtgcacgagaacatcaatggaaagtatgagtgggtcgttaagcccaagtccgtaaaatacgagttcaagactgacgcgcgcgtccccaagctcggggttatgctggtggggtggggcggaaacaatggttccacactgactgcgggtgttattgctaacagagagggaatatcttgggtgacgaaggagaaagtacagcaggcaaattactttgggtcgctaacccaagcatccacttgcagaatcggatcatataatggcgaagagatttacgctcctttcaagagcctccttcccatggtggaccctaacgatatcgtattcggaggatgggatatcagcaacttgaatttggcggatgccatggcccgagccaaggtactcgatattgacctccagaaacagctgcgcccatatatgcacgacatggctcctcttcctggcatttacgatccggatttcatagctgcaaaccaaggcgagagggcagataacatcatcaagggttccaagaaggatcaagtgcagaaaatcattcaagatattagagaatttaagtcgaaaacaaaggtggacaaagtagtggttctgtggactgcgaataccgaacgatatagcgacgttatagtggggctgaatgacaccaaacagactctgctcgcatctttggaaaggaacgaatcggagatctcgccatcgactctgtatgctatggcttgtattcaggaaaacgttcccttcatcaacggcagccctcagaacacctttgtaccaggtctgatagagttggccattgagaaaaacagtcttatcggaggggatgacttcaagagtgggcagacaaagataaagtctgtgcttgtggatttccttgttggtgcgggtatcaagccaacggccattgtgagctacaaccatttgggaaacaatgacggaatgaacctgtcagctccacagactttccgttctaaggaaatttctaagagcagtgttgtagacgacatggtttccagcaatgccattttatatggccccggtgaacacccagaccatgtgattgtcatcaagtatgtgccctatgttggagacagcaagagagccatggacgaatacacttcagagatcttcatgggtgggaagaacaccatagtactccacaatacctgtgaggactctctgcttgcagctcctttgatcttggatctggtcttacttgctgaactcagcaccaggatccagcttaagaaagaaggcgagccgaaattccactctttccaccctgtagcaactattctgagctacctcaccaaagccccattggtgccacccggcactcctgtggtgaatgcccttgcaaaacagagggctatgctggagaacatattgagggcatgcgttggactgtctcccgagaataacatgatcctcgagtacaagtgaaaggcaaagactggggcactatcgccatatgcggggtggagcagatcagagtagagcatggacatgcatgtacagggttccgtttcctcgttgccaatgagctaatggagaagatggtgaatcagatcagtgtttaaatttgacggcgtatacccgtcttttcattttttccctgtattttagacaggccgtattagacagagtatgaagttttcccttatctgtgataaataatacttataaatttaagagcagcagtacgtatccatctgtttatgtccagattattcatgtgatattcattgttttcaccattgtgatatgttcatccaatattttcttaaagcaaacggtaattgttaaaaaactactcttatgttatgcactgttttgaccattgctgtcgcccgtatgaggtgttcatcacccg

SEQ ID NO: 585 - DNA, 1943 bp, Cephalotaxus
gttttggcatttaggccgtcttctggtataaaacgaacacacgacagagtcctctaataacagtcgcagcgcagagcagttcagttccagcctgcattttcattccattttggaaacatgtttattgagaagtttcgcgtgcaaagccctaatgtgaagtacagtgaggagagtatcgaatctgtgtatgactttgaaaccactgagctggttcatcagaacactaatggaaagtatgagtgggtcgtcaaacccaaatctgtcaaatatcagttcaagactgatacccgggtccccaagctcggcgttatgctggtgggttggggaggaaacaatggctccaccctgaccgcgggtgttattgccaacagagagggaatctcttgggcgacgaaggataaggtacagcaggcaaattactttgggtctctcacccaagcatccacttgcagaatcggatcttacaatggcgaagaaatctacgctcctttcaagagcctccttcccatggtggatcctaatgacatcgtatttggcggatgggacatcagcgacctaaatttggcagatgccatggcccgagccaaggtgctcgacattgacctccagaagcagctgcgaccctacatgcaagacatggtgcctcttcctggcatctttgatccagatttcatagccgcaaaccaaggtgaaagggcaaatcatatcatcaagggttcaaagaaggaacaggtgcagcaaattgttcaagacatcacggagttcaaggcgaaaacaaaggtggacagagtagttgttctctggactgccaatacagaacgatacagcaacgttatggtggggctgaacgacacaaaggagactctgttggcatctctggaaagggatgagttggagatctcaccctcgactctttatgctctggcctgtattcaggagaacattcccttcatcaacggcagtcctcagaacacctttgtaccaggtctgatagagttggccattgagaagaacagtcttattggaggggatgatttcaagagtggtcagacaaagatgaagtctgtgcttgtggatttccttgttggtgctggtatcaagccaacagccattgtgagctataatcatttgggaaacaatgatgggatgaatttatcagctccacagactttccgctctaaggaaatttcaaaaagcaatgtagtagacgacatggtttccagcaatgccattttgtatgggcctggtgaacaccctgatcatgtgattgtcatcaagtacgtgccctatgttggagacagcaagagagccatggacgaatacacttctgagattttcatgggagggaagagcaccatcgtactccacaatacctgtgaagactctttgcttgcagctcctttaatcttagatttggtcttacttgctgaacttagcaccaggatccagcttaagaaagaggacgaggccaaattccactctttccatcctgtagcaactattctgagctacctcaccaaagccccattggttcccccgggcactcctgtggtgaatgctctagcaaagcagagggctatgttagagaacataatgagggcttgcgttggactggctccggagaataacatgattctggagtacaagtgaaaggcataggctagctcagattagacatgagggacagcctggggacgtgcatgcagagggtttcgttttgtggttttagatgagctgaaggatcctcatcttgtgtttcctctgtggttaataagaattagaaaaggaaaattggaatattgttttcaggtgtattggaatattccttcgttttgatatatattttttccattacgattcatctattagtgacctcttaatttgaattaaggaatcttgcaaaacagtttagtaatgatattttaaaagaatgaattttactt

SEQ ID NO: 586 - DNA, 1949 bp, Cephalotaxus
gccacatattgatcagactttggcggcctctttgggcaccagtcgaacgaggcggtctccaagacacaaaagtccaacctgcgttctcgccccaagttcagctgtgagctgatttttcgtccgtttagtttatttctagacttaaaaccttccccgcattgtccaattccgcagcatttctttccaagatttctgcttccgccgttgtaacttgctgcccgcccctgtgcccttgaaaatgtttattgagagcttccgcgtgcagagccccaatgtgaagtacacggaggagagcatagagtcggtgtatgactacgctacgacggagctagtgcatgagaacacaaatggcaggtacgagtgggtcgtcaggcctaagacagttacgtacgatttcaggactgatacgcgggtccctaagctcggggttatgctggttggatggggcgggaacaatggctctaccctgaccgctggggttatcgccaacagggagggaatctcatgggtgacgaaagacaaagttcagcaggcgaattactttggatcgctcacccaggcatcaacatgcaggatcggatccttcaatggcgaggaaatttacgcgcctttcaagagccttcttcccatggtggacccgaacgatatcgtgtttggcggatgggacatcagcgacatgaacttggccgacgccatggcgagagcaaaggtgctcgacattgacctgcagaagcagctccggccctacatgcaagatatgatacctctccccggaatcttcgacccggatttcatagctgcaaaccaaggcgagagagcaaataacattgtcaagggttccaagaaggaacaaattgagaaaataattcaggacatcagggaattcaaggcaaaaacaaaggtcgagaaagttgttgtcctctggaccgctaacaccgaacgatacagcgacgttattgtagggctgaacgacacgaaggaaaccctctttgcatctgtggaaagaaacgagtctgagatctcgccgtcgactctctacgctatagcttgtgtgcaggagaacgttccttttatcaatggcagtcctcaaaacacatttgtcccaggactgatagactttgccatcgaaaagaacagccttataggaggggatgacttcaagagtggacagacgaagatgaagtctgtgcttgtggacttcctggttggtgccggtatcaagccaactgctattgtgagctacaaccatctgggaaacaacgacgggatgaatctgtcagctccgcagactttccgctccaaggaaatttcgaagagcaatgttgtagacgacatggtgtccagcaacgctattctgtatgggcctggcgaacatcccgaccatgtcgtcgtcatcaagtacgtgccttatgttggagacagcaagagagccatggacgaatacacgtcggagatcttcatgggagggaagagcaccatcgtccttcacaatacttgcgaggactctctccttgcagctcctctgatcttggacttggtcttgctggcagagcttagcaccaggatccagctcaggaaagagggcgaggcaaaattccattctttccatcccgtggcaactattctgagctacctcaccaaagcccctctagtgccacctggcacgccagttgtgaacgccttggcgaagcagagggccatgctggagaatatcatgcgggcatgcgttgggctggctcccgagaacaacatgatccttgagtacaagtgaaatgctggcgccgagtcggcttccacgtggctatataagttttttaatttctttttaattgtctgaactccgtattatgttgtggctgggcccacacttataaaggaggttgttttacgttgtaaaatttccacaaccttctaattttcaatctggagtgcgatttatttataaaacg

SEQ ID NO: 587 - DNA, 1941 bp, Cephalotaxus
gccacatattgatcagactttggcggcctctttgggcaccagtcgaacgaggcggcctccaagacacaaaagtccaacctgcgttctcgccccaagttcagctgtgagctgatttttcgtccgtttagtttatttctagacttaaaaccatccccgcattgtccaattccgcagcatttctttccaagatttctgcttccgccgttgtagcttgctgcccgcccctgtgcccttgaaaatgtttattgagagcttccgcgtgcagagccccaatgtgaagtacacggaggagagcatagagtcggtgtatgactacgctacgacggagctagtgcatgagaacacaaatggcaggtacgagtgggtcgtcaagcctaagacagttacgtacgatttcaggactgatacgcgggtccctaagctcggggttatgctggttggatggggcgggaacaatggctctaccctgaccgctggggttatcgccaacagggagggaatctcatgggtgacgaaagacaaagttcagcaggcgaattactttggatcgctcacccaggcatcaacatgcaggatcggatccttcaatggcgaggaaatttacgcgcctttcaagagccttcttcccatggtggacccgaacgatatcgtgtttggcggatgggacatcagcgacatgaacttggccgacgccatggcgagagcaaaggtgctcgacattgacctgcagaagcagctccggccctacatgcaagatatgatacctctccctggaatcttcgacccggatttcatagctgcaaaccaaggcgagagagcaaataacattgtcaagggttccaagaaggaacaaattgagaaaataattcaggacatcagggaattcaaggcaaaaacgaaggtcgagaaagttgttgtcctctggaccgctaacaccgaacgatacagcgacgttattgtagggctgaacgacacgaaggaaaccctctttgcatctgtggaaagaaacgagtctgagatctcgccgtcgactctctacgctatagcttgtgtgcaggagaacgttccttttatcaatggcagtcctcaaaacacatttgtcccaggactgatggactttgccatcgaaaagaacagccttataggaggggatgacttcaagagtggacagacgaagatgaagtctgtgcttgtggacttcctggttggtgccggtatcaagccaactgctattgtgagctacaaccatctgggaaacaacgacgggatgaatctgtcagctccgcagactttccgctccaaggaaatttcgaagagcaatgttgtagacgacatggtgtccagcaacgctattctgtatgggcctggcgaacatcccgaccatgtcatcgtcatcaagtacgtgccttatgttggagacagcaagagagccatggacgaatacacgtcggagatcttcatgggagggaagagcaccatcgtccttcacaatacttgcgaggactctctgcttgcagctcctctgatcttggacttggtcttgctggcagagcttagcaccaggatccagctcaggaaagagggcgaggcaaaattccattctttccatcccgtggcaactattctgagctacctcaccaaagcccctctagtgccacctggcacgccagttgtgaacgccttggcgaagcagagggccatgctggagaatatcatgcgggcatgcgttgggctggctcccgagaacaacatgatcctcgagtacaagtgaaatgctggcgccgagtcggcttccacgtggctatataagttttttaaatttctttttaattgtctgaactccgtattatgttgtggccgggcccacacttataaaggaggttgttttacgttgtaaaatttccacaaccttctaattttcaatctggagtgcgatttatt

SEQ ID NO: 588 - DNA, 2324 bp, Distylium
ggacaccagttcgacctccgttgttgccaccaattgcctaagctgacgctcatatctcgttctcgtgacatacctacgcagcctacagcgaatttctagattcttcgacctccacttccaccgctatagaatctctgataaaatccccaccaaccctcctgccatatttgcccgctggttctgtgaactttcttattttatccctgagatcattgtcccgccatttttggtgcctgtcacggtttaaagtcaagttattcccctccttgggctttcaaggttttggctgcctcgttttcttgctggtatctttgcttgcttttgctttaaaatgtttatcgagagcttccgcgtgcagagccccaacgtcaagtacaccgaggatagcatcgaggcggtgtatgactatgcaaccaccgagcttgttcacgagaatagaaatggcaagtatgagtgggtcgtcaagcccaagagcgtgaaatacgagttcaaaaccgatacgcgggttcctaagctcggggttatgctggttggatggggtgggaacaacgggtccacactgaccgccggtgttatagctaacagagagggaatctcatgggttacaaaggaaaaagtgcagcaggcaaactacttcggctctctcacacaagcgtccacctgcagaatcggatcctacaatggcgaagaaatccacgctcctttcaagagccttcttcctatggtggaccctaacgaaatcgtttttggcggatgggacataaacaacatgaacctggctgacgctatggcgcgagccaaggtgctcgagatcgacctgcagaagcagctccggccctacatgcaagacatgttacctcttcccggcatctacgacccggatttcatcgccgcaaaccaaggagagagggcaaataatattatcaagggttccaaaaaggaacaagtggataggattattcaagacatcagggaatttaaggcaagcacaaaggtggaaaacattgttgtcctctggacggctaacaccgaacgatacagcgacgtaattgttggattgaacgacacaaaggaaaacttatttgcatctctggaaagaaacgagttcgagatctcgccttcgactctctatgctctcgcttgcgtgcaggagaacatcccctttatcaacggcagtcctcaaaacaccttcgtcccaggtttgatcgagttggccatagagaagaacagtctgatcggaggagatgacttcaaaagcggacagacaaagatgaagtccgtgctcgttgatttccttgtgggtgcgggtatcaagcctactgctatcgtgagttacaaccatttgggaaacaacgacggaatgaatctgtcagcaccacagactttccgctccaaggaaatttctaagagcaacgttgtcgacgacatggtttccagcaacgccatcttgtatggacccggagaacaccctgaccatgtcgtcgtcatcaagtacgtgccttacgtgggagacagcaagagagccatggacgaatacacgtccgagatcttcatgggagggagaaacaccatcgtgctccacaatacatgcgaagactccttgcttgcagctcctctcattttggatttggtgttacttgccgaactttgctcccgaatccagctcaagcgggagggcgagtcaaaattccactccttccatccggtggccacgattctaagctatctcaccaaggcgccgttggtgccacctggcacacccgtggtgaacgccctggcgaagcagagggcaatgctggagaacatactgcgggcatgtgtaggactggctccggagaacaacatgatccttgagtacaagtgaagggctggcgctcagtcggcctacaccaagggcaactccgacccagggccattgatggtgctgccgcaactggagcagcacgaggagagcagtagcagtagcagtaccagtcacagcacgcgtggttgtggctttttagtttttacctacttacctagaattgtggttatgaagaaacgtctgtcagtgttgcgggctgtggttgtaaataaacgtctgtcagtgttgtggcccacaatgagtccagtccatgtttccctttcctgttttgggtttgtaaacctaaacctcgctgtattgtattttaatcttcctatgatttattggtagtcatagttgccaacaaatctatgaaacggcaatatgtatgttattcgaactgtcaaggaatattttaaaaaaaggtcataaattgaagtttccgtacgaaatagaggtgaccattatgtcattggattca

SEQ ID NO: 589 - DNA, 2154 bp, Sciadopitys
gcgagagtgaggcacatatatagagcttactctttggccaccagtcgaaagccctttcacacacatctaagccttgcattttcgccaccagtgagctgaacaggagcttttttaagtctgcgacttttcttgattcttcgccaactcctacttacttgataaaaccccgccattacagttgtttcttcactttaggtttttcttggcccagcttctgtaaagttttttcttgtgttcaaattgttgacccgcgtctgtccgaattcttagctttgctctaaattaatttagggtttgaaaatgtttatcgagagattccgcgtgcagagccccaatgtgaaatacggcgaggggagcatccagtctgtgtatgattattcgactactgaactcgttcatgacaacaacaatggaaagtacgagtgggtggttaggcccaagactgtcaagtacgagttcaacactgattcgcgggtccccaagctcggggttatgctggttggatggggcggtaacaatggctctactcttaccgctggtgtaattgccaatagagaggggatctcctgggtgacgaaggataaggtgcagcaggcgaactattttggctctctcacacaggcgtcaacttgcaggatcgggtcctacaatggggaggaaatttacgctcctttcaagagccttcttcccatggtggacccgaacgatatcgtcttcggcgggtgggacataaacaacatgaacctggcagacgccatggcccgggccaaagtgcttgacattgacctgcagaagcagctccggccatacatgcaagatatggcgcctcttcccggcatctttgatcccgatttcattgctgcaaatcaaggagagagggcgaataatatcatcaagggttccaagaaggagcaagtgcagcaaattgttcgagacatcagggaattccaggcgaaaacaaaggtggaaaaagtagttgtcctctggactgctaacaccgaacgttacagcgacgttatagtggggttgaatgataacaaagagaccctgcttgcatctctggagagggacgagcctgaaatctcgccgtcgactctgtatgctcttgcttgcgtgcaggagaacgttcccttcatcaatggcagccctcaaaacacctttgtcccaggtctgatagatttggccattgaaaagaatagtcttatcggaggagatgatttcaagagtgggcagacaaagatgaagtctgtgcttgtggatttcctggttggtgctggtattaagccaactgctattgtgagctacaaccatctgggaaacaacgacggtttgaatctctcggctccccagactttccgctccaaggaaatctcaaagagcaatgttgtagacgacatggtttccagcaatgctattctgtttggacccggtgaacaccccgaccatgttgtcgttatcaagtacgtgcctaatgtgggagacagcaagagagccatggacgaatacacctcggagatattcatgggagggaagaataccattgtactacacaacacctgcgaagactctctccttgcagctccacttatcttggacttggttttactcgctgaactcagcaccaggatccagctgaagaaagagggcgaggcaaagttccactccttccacccggtggcaactattttgagctacctgaccaaagccccgctggtgccacctggcacgccagtagtgaacgccctggcgaagcagagggcgatgctggagaacattatgagggcatgcgttgggctggcacccgagaacaacatgatcctcgagtacaagtgaaacgctggcgctgagtcggcatacacgtggcggcgtagcccgcacatttcatagtactgtagtttaaggatgaatgcatttgtgggaagcctctttttctagtgttttctctactttgtaaactttccgtgacttcttaaatttcgcttttctatgcgaaaaatttccatgcttttctcaactttgtaaattttcctttacttcttaaatttcacttttcgatgcgattttttcgcgtgttatagtgtactttggtagtgatggtttgggaaaaaagtatgtttaaattattggagctattataaaaaagttgtaaataac

SEQ ID NO: 590 - DNA, 2213 bp, Sequoia
actacattgatcatcaatcaatttttgttgtgtaatcactaaccacaatggaaacacaatgtcacaaggatatctattttacttttataattcgtagtaaccagagtagagccacaaaatgaggagtggcagctgattgaaaaccacagaagtataaaaccttctgcatgcatgtccccggagcccgggctgtccgtcacatgcttatgtttttcacttgtattctaacatcatgttattctctggtgccagtcccacgcatgccctcatgatgttctcaagcatagccctctgttttgccagggcgttcaccacaggagtaccagggggaaccaatggggctttggtcaggtagctcagaatagttgctacagggtggaaagagtggaatttggcctcgccctctttcttaagttgaatcctcgtgctaagttctgcaagcaataccagatccaatattaaaggagctgcaagcaaagagtcttcacaggtgttgtggagtacaatggtgctcttgcctcccatgaaaatctcagaagtgtattcgtccatggctctcttgctgtctccaacatagggcacatacttgatgacaaccacatggtcagggtgttcaccaggcccatacaaaatggcattgctggaaaccatgtcatctacaacattgctctttgaaatttccttagagcggaaagtctgtggcgctgacagattcatcccgtcgttgtttcctaaatgattgtagctcacaatggcggttggcttgataccggcaccaacgaggaaatccacaagcacagatttcatctttgtctgaccactcttgaagtcgtcccctccaataagactgttcttctcaattgccaactctatcagacctggaacaaaggtgttctgaggactgccattgatgaagggaacattctcctgaatacaggccagagcaaaaagcgttgagggcgagatttcaggttcgtccctttccagagatgccaacagagtctcctttgtgtcgtttagccccaccataacgtcactgtaccgttctgtattggcagtccagagaacaactattctgtccacctttgtttttgccttaaactccctaatgtcttgaacaatttgctgcacctgttccttctttgaacccttgataatattatttgctctttcaccttggtttgcagctataaaatcaggatcaaagatgccaggaagaggcaccatgtcttgcatgtaaggtcgcagctgcttctggaggtcaatgtcgagtacctttgctcgggccatggcatctgccaaattcaggttgctaatgtcccatccgccgaatatgatatcgttagggtccaccatgggaagaaggctcttgaaaggggcataaatctcttcgccattaaaagaaccgattctgcaagtggaggcttgggtgagagacccaaagtaatttgcctgctgtactttatcctttgtcacccaagagattccctctctgtttgcaataacacccgcggtcagggtggagccattgtttccaccccatcccaccagcataaccccgagcttgggaagcctagcatcagtcttgaactcatatttaacagacttaggcctgacgacccactcatacttcccattcctgttctcatgaacgagctcagtggtttgataatcatacacagactcaatactctcctcactgtacttcacattggggctctccacacgaaacttgttaataaacattttcccaaccgatccctcactgcttctgctcctgttaccaactaacttatcactacaccagcaggaattcagttatcaacatttttgtctccgtcccttacatcaatgtcttcttttagtacacagccagtaggtgctatggattcagtgtcttctgttgtcagcatgctgaaggggacattggagcgtaagaaattaggaactaaccaatttaataagggaatcccaatagataatgcttttggcccttatgttcatgacgaaaatatttactgtatgaaccaaaatcataattcatttttcaagttcctgagcctgaagaaagggtgcaaacagctaagcttatccaagtgaaagagaatgagcaagcacaacaagttactcatttaaatcaggatagggaaacagaagcattagatgtagctccaaatcagttacaaacagtgcaatgtacacaagaaccatca

SEQ ID NO: 591 - DNA, 2265 bp, Maritime pine
ccagcggtgtgaggaggagagtgaagcagagttagtgtgaggaggagagtgaagcagagtttctgtggtctgccaattttctgatcaaggactgtcgttccgatttgtggactgaatttggctttgcgtcccgttcagttggagcatttctttcgagaatttcaagcgcgaccccaacgaagctattatttgttcgcccgtgaaactcttctcgttcacccgtgcgtgctttgaccctatccgtttgcctgtgattgatttctgcgttgatattcgcttcgctacttctggcctacctgtgcaatttctaatttaggcacagggctttccatattctttccttgttctgcgcacgattcttgggcgtaatcaaagctattatccagtctctccatcgcctgttattacctttccccttttctactttgctgatctcgtctcctctgtgctgtctggtaaagatgtttatccagaacttccgcgttgagagccccaacgttaagtactctgaggaatgcatcgactcgatctatgactaccagacgaccgagctcgtgcacgagaatgccaatggcaaatatgagtgggtggtcaagcccaagaccgtgcgatacgagttcaaaacggagagacgggtccccaagctcggggtcatgctcgtcggatggggaggaaacaatggttccacgctcacagcgggtgtgattgcgaacagagaaggaatctcgtgggtgacgaaggaaaaagtacagcaggcaaattatttcggttccctcacgcaagcttcgacctgcagagtcggatccttcaacggcgaagagattcatgctccttttaagagccttcttccaatggtggatcctaatgcaatcgtctttggtggatgggacataaacaacatgaatctggcggatgccatggcccgagccaaggttcttgacattgacctacagaagcagctgcggccctacatgcaaggcatgaatcctcttcctggtatatatgacccggatttcatagcggcaaaccagggtgagagggcaaataatgtcatcaaaggctccaagaaagagcagctgcaaaagattatcgaagatatcagagattttaaatcgaaaacaaaggtggacaaggtagtcgtactgtggactgctaataccgaacgatacagcgatgttatcgtgggtttaaatgacacaaaggaaaccctgcttgcttctctggaaagaaatgagtccgaaatctcgccatcgactctgtacggcttggcatgcgttcaggagaacgttcccttcataaacggcagtcctcaaaacaccttcgttccaggattgatcgatttagcaattacaaagaacagtatcatcgcaggagatgacttcaagagcgggcagacaaagatgaagtcggtactcgtggatttcctagtcggtgccggtcttaagccaacttcgattgtgagctacaatcacctcggtaacaacgatgggatgaatctgtcagcaccccagactttccgatcaaaggaaatttcaaagagcaatgtcgttgacgacatggttgccagcaacgccattctttacgaaccaggggaacacccagaccatgtcgtcgtcatcaagtatgtaccttacgttggagacagcaagagagccatggacgagtacacgtccgagatattcatgggaggaaaaaacaccctcgtaatccacaatacatgtgaagattcgcttcttgcagctcctctgatcttagacttggtgctgctcgccgaactctgtaccaggattcaacttaaaaaggaaggcgaggggaaattccattctttccacccggtagcaagcattttaagctacctcaccaaagcgccactggtgccaccaggcacgcctgtcgttaacgccctggcgaagcagagggcgatgctggagaacatcatgagggcctgcgtcggcctcgctcccgaaaacaacatgaccctcgaatacaagtgaattgctggggtcagatcgacatcctaagtggcatgggtttattcatcggactgatgaagaagaaaaacagggtggtccactcgaatgagcagctacagtgtttctggtacccttttgtaataaaatctacctgatgtcgtcttgttatgccatataattttacggtcccaagtcgtttgtgattaataataagcgattgtagaagtgtgacttgtttaaaagttttcgaaccaagatgaagtatatatgttcattttggtgattgttaata

SEQ ID NO: 592 - DNA, 1938 bp, Zamia
gcagtctctgccttgctgctcttcttcttctccttcgtcagatctgtgtgtgcctcttcttccgcctcaagcctgcgaaaatgttcatcgagagcttccgcgtggagagcccctacgtgaaatacacggaggagagcatcgaatcggtgtataactacgagaccacggaggtcgtccacagccgcgacagccgcactgggaagtacgagtggatcgttaagccaaccacggttaaatacgagttccacacgcagacacgtgtcccgaagctcggggtgatgctggtaggatggggaggcaacaacggatcgactctcactgccggcgtcatcgccaacagagagggaatgtcgtggctgaccaaggagggagcacggcgggcgaattatttcggctccttgacgcaggcgtctacttgcagagtcggatccttccatggcgaagagatctacgctccgttcaagagccttctccccttggtcgatccgaatgatattgttttcggcggttgggacatcaacgacatgaatctggcggacgccatggccagggccaaggtgctcgacatcgatctgcagaagcagctgcggccgtacatggaaggcatggttccgctccccggcatttacgatgcggacttcattgccgcgaaccaggactccagggcaaataacatcatcaaaggcaccaaaaaggagcaggtgcagaggatcgtgcaagacatacgggaattccgggccaaaacaaaggtggagagagtcgtggtgctctggacggctaataccgagcgatacagcaacgttctggcggggctgaatgacacggaggagaatttgctggcgtccttggagaggaacgaagcggagatctcgccctcgacgctgtatgccttggcttgtattcaagagaatgttcctttcatcaatggaagccctcagaacacctttgttccaggcctgatagacttggctatttcgaagaacagcctcattggaggagacgacttcaaaagcggacagacaaaaatgaagtcggtgctggtggatttcctcgtcggcgctggtatcaagccgaccgccatcgtgagctacaatcacctcggcaacaacgacggaatgaatctttcggctccgcagaccttccgctccaaggaaatctcaaagagcaatgtcgtggacgacatggtttccagcaacgccatcctgtacgaacctggcgagcatccggaccacgttgttgtcatcaagtacgtcccttatgtaggagacagcaagagagccatggacgaatacacttccgagattttcatgggagggaagagcactatcgtactccacaacacctgcgaagactctctgctcgcggctcctctaatcttggatttggtcctgctggccgagctctgcaccaggatcaagctcaagaaagagggagagggaaaattccattctttccacccggtggcgactattttgagctacctgacaaaagctccgcttgttccgccggggacgcctgtggtgaatgctctggcgaagcagagggcaatgctggagaacatcctgagggcatgcgttggcttggcacccgagaacaacatgatgctggaatataaatagagaggttgcagcactgcacagaatggccgcgtttagtagtaggtagtattttggctgcggccgacggtttcttctcgtttgctgaagtttttctgctaaaacgccgctaaatatagcatcgacatcgtgtctaccgtagggttgcagtatgtaatttttccagtgctactgaattggaggaaaaagagagaaaccctgaagtagattcttggtgagattaactcatatatttatgtggcttttcggttcttatatatataaatttaagataatttttatcatgtattgcgcataaaaaatgttaattaatgcttaattt

SEQ ID NO: 593 - DNA, 2449 bp, Pine
taatatgatactgaagattattttctacactagaaatttaagggctggtttactaattaaattgaagcaaggagctcttatccgatgcgatcagggcgggagaccttgatttggagaaaaaattgagagacatggatccaagccttaaggtcactcaacaaacctttaccagcggctgagctccctgcacatttctgcactatatggccgtgctataagaagtcgcttgatttaatacggtggtaatagaggcattgagtttacaggttatggaacttctggagacggggcacactaccaactccagcagtgtgaggaggagagtgaggcagagttagtgtgaggaggagactgaagcagagtttgggtggtctgccaattttctgtgtgcaatttctaatttaggcagagggctttccatattctttccttgttccgcgcacgattcttgggcgtaatcaaagctattatccagtctctccatcgcctgttattacctttccccttttctactttcgctgatctcgtctcctctgttctgtctggtaaagatgtttatccagagcttccgcgttgacagccccaacgttaagtactcagaggaaagcatcgactcgatctatgactaccagacgaccgagctcgtgcacgagaatgccaatggcaaatatgagtgggtggtcaagcccaagaccgtgcgatacgagttcaaaacggagagacgggtccccaagctcggggtcatgctcgtcggatggggaggaaacaatggttccacgctcacggcgggtgtgattgcgaacagagaaggaatctcctgggtgacgaaggaaaaagtacagcaggcaaattatttcggttccctcacgcaagcttcgacctgcagaatcggatcctttaacggcgaagagattcatgctcctttcaagagccttcttccaatggtggatcctaatgcaatcgtctttggtggatgggacataaacaacatgaatctagcggatgccatggcccgtgccaaggttcttgacattgacctacagaagcagctgcggccctacatgcaaggcatgactcctcttcctggtatatatgacccggatttcatagcggcaaaccagggtgagagggcaaataatgtgatcaaaggctccaagaaagagcaactgcaaaagattatccaagatatcagagattttaaatcgaaaacaaaggtggacaaggtagtcgtactgtggactgctaataccgaacgatacagcgatgttatcgtgggtttaaatgacacgaaggaaaccctgcttgcttctctggaaagaaatgagtccgaaatctcgccatcgactctctacggcttggcctgcgttcaggagaacgttcccttcataaacggcagtcctcaaaacaccttcgttccaggattgatcgatttagcaattacaaagaacagtatcatcgcaggagatgacttcaagagcgggcagacaaagatgaagtcggtacttgtggatttcctagtcggtgccggtcttaagccaacttcgattgtgagctacaatcacctcggtaacaacgacgggatgaatctgtcagctccccagactttccggtcaaaggaaatttcaaagagcaatgtcgtcgacgacatggttgccagcaacgccattctttacgaaccaggggaacacccagaccatgtcgtcgtcatcaagtatgtaccatacgttggagacagcaagagagccatggacgagtacacgtccgagatatttatgggaggaaaaaacacccttgtaatccacaatacatgtgaagattcgcttcttgcagctcctctgatcttagacttggtgttgctcgccgaactctgtaccaggattcaacttaaaaaggaaggcgaggggaaattccattctttccacccggtagcaagcattttaagctacctcaccaaagcgccactggtaccaccaggcacgcctgtcgttaacgccctggcgaagcagagggcgatgctggagaacatcatgagggcctgcgtcggcctcgctcccgaaaacaacatgaccctcgaatacaagtgaattgctgtggtcaggtcgacatcctaagtggcatgggtctattcatcgtactgatgaagaagaaaaacagggtggtccactcgaatgagcatctacagtgtttctggtacccttttgtaataaaatctacctgatgtcgtgttgttatgccatataattttacggtcccaagtcgtttgtgattaataataagcgattgtagaagtgtgactgttaaaaagttttcgaaccaagatgaagcgtatatgttcattttggtgattgttaataaaatacaactttttcaacttgatgtctctttcgtgctattggatacgggttttgatgtctctttttgtgttattggattaccggttttggctggc

SEQ ID NO: 594 - DNA, 1880 bp, Podocarpus
tacgccagttatagtgggcaagtagggcattagtggttgcagttggggcgtgaattttcgaagacaaagtgagaaaatgtttatcgagagcttccgcgtgcaaagccccaatgttaagttcactgaggagagtattgaatcggtgtatgagtattctacgactgagctcgttcacgagaataagaatgggaagttcgagtggatcgtcaagcccaaatctgtgatatacgagttcaagacagatcgaagggttccaaagcttggggttatgctggtgggatggggtgggaacaatggctccaccctcaccgctggtgttattgccaacagagagggtatctcttgggtgaccaaggattcggtccagcaagcgaactatttcggttctctcacccaggcttctacttgcaggatcggatccttcaatggcgaagagatttacgctccattcaaaagccttttgcccatggtggatcctaatgaaatagtgtttggaggatgggacatcagcgacctgaatttggcggatgccatgacccgggctaaggtactcgacattgacctccagaagcagctacgcccttacatgacagacatggaacctcttcctggcatctatgatccggatttcattgctgcaaaccaaggcgaaagggcaaacaatatcatcaagggttccaagaaggaacaagtccacaaaatcatacaggatatcagggaatttaaggcaaaaacgaaggttgaaagagtggtagttttgtggacagctaatacagaaagatacagcgaagtaatggtagggctgaatgataccaaagagaatctccttgcatcactcgaaaggaacgaggctgagatttcgccctccactttgtatgctctggcgtgcattgaggagaacgttccattcattaatggcagtcctcagaatacctttgtaccaggtctgatagagatggcaattgagaagaacagtctcatcggaggggatgacttcaagagcgggcagacaaaaatgaaatctgtgcttgtggattttcttgttggtgctggtattaagccaactgccattgtgagctacaatcaccttggcaacaatgatggaatgaatctgtcagctccacagactttccgttccaaggaaatttcaaagagcaatgttgtagacgacatggtctccagtaacgctatactgtacggtcctggtgaacaccctgaccatgtagtggtcatcaagtacgtgccatatgttggagacagcaagagagcaatggacgaatatacgtctgagatattcatgggaggaaagaacaccatcgttcttcacaatacctgcgaagactctcttcttgcagctccattgatcctggacttagtcttacttgctgagctttgcacacggatccagcttaagaaagagggagaggcaaaattccactctttccaccctgtggcaactcttctgagctacctcaccaaagctccactggtaccacctggcacacctgtggtaaacgctttggcgaaacagagggctatgctggaaaacatactgagggcgtgcattggacttgccccggaaaacaacatgatgctggagtacaaatgaagcgcagaggggcgtggaatctgtgtatgggccatccagacagcggtttgctttgagattttgagttaatggcttctctgtcctcatacctacgaggccttggagttgttcccttcgataatatgaatttgtatcatattctcaaagttgatttttactacctgtagttatggtcattattaatacaagagaaagctcctttagtatgggcttagttttaatgatgttaagacacatgtttacctttccaattttaaacttttatatattt

SEQ ID NO: 595 - DNA, 1730 bp, Flaveria
aaattcactctctgtacaactacgacaccactgaactcattcacgaggagaaaaacggtgcttatcaatgggttgttaagccaaaccgttaaatacgagttcaaaacgcaaactcgtgtccctaaactaggggttatgcttgttggatggggaggtaacaatggctccacgctaaccgccggtgttatcgcgaatcgggagggaatatcttgggcaaccaaagagaaagtgcaacaagccaactactttggctccttgactcaagcttcaactatcagagttgggtccttcaatggagaggagatctttgcccctttcaagagcctcctccctatggtgaacccagatgacatagtgtttgggggatgggacataagcagcatgaacttggctgatgccatggctagagccaaggttttggacattgatctccaaaagcaattaaggccttacatggaatccatggtcccactacctggtatctatgaccctgacttcattgctgcaaaccaaggtgaacgtgcggataacgtgatcaagggaaccaaaaatgaacaaatccaaaagatcattaaggacatcagggagtttaaggaggctaacaaggtagacaaagtggtggtcctgtggactgccaacacagaaagatacagcaatgtaatggttgggcttaatgacacaatggaaagcctgtttgcatcattagacaaaaatgaagctgagatctcaccatcgaccttgtatgctattgcttgtattcttgaaaatgtgccattcatcaatggaagcccacaaaacactttcgtaccaggggtaattgatttggctatcaaaagaaacagcttgattggtggagatgactttaagagtggtcaaaccaagatgaagtctgttcttgttgacttccttgttggagctggcatcaagccgacatccatcgtgagctacaatcacttgggaaacaatgacgggatgaacctctcagccccacaaacattcagatccaaggagatctccaagagcaatgttgttgatgacatggtttccagcaatgccatcttatacgagcctggggagcatcctgaccatgtggttgtcatcaagtatgtgccatacgtcggagatagcaagagggcaatggatgagtacacatctgagatattcatgggtggtaaaagcacaatcgttctacacaacacgtgtgaggactcactgttggctgctccaatcatcttggacttggtcctgctcgctgagctcagtactcgcatccagctcaaagctgaagatgagggtaagttccattcgttccatccggtggcaacgattctgagttacctcacaaaggcccctcttgtaccaccagggacaccagtggtgaatgcgctcgcaaagcagagggcaatgctggagaacatactgagggcttgtgttggattggcaccagaaaacaacatgatcttggaatacaagtgaagtgagcatgtgatgacgtgcatgccgtatgatatatgatgttttttatttggttttcgttttcaaatgtaattcgtgtgcttagctttatggaagtatttatttggaggtgaatatatcccaaaataagccaaattttgtggtgaatatgcatccattagtcgcttacacgcgtcaaatagttgtatggaatttaatccctcctaatgttttaagttgttggtaataccaaaattatatatgttctcgttcac

SEQ ID NO: 596 - DNA, 2107 bp, Cycas
ctcctttscgcccattgggagtgagtccaacgaaatcactgccattgatgactggcgattcgctgagctttctttagcatttcttttctgacgcgaatactttatatttggcgcgggggcattggcttcgccctcggttctggtctttatcattgcctgcgccgtgttggtttcaatcttcgtggttttgccccgttctggagtgtgttcgctgttcgattcccgggaaaatgtttgtccagagcttccgcgtggagagcgacaacgtgaagtactcagaggatagtatagagtcggtgtataactatgagacgacggagctcgtgcacgagaacaggaatggcaagtacgagtgggtcgtgaagccgaggactgtgaaataccagttcgaaactgaccgtcgggtccccaaattaggggtaatgctcgtgggatggggtggaaacaacggttccactctgactgctgcggtgattgcaaatcgggagggaatctcgtgggtgactaaagagagagtacaacgggcgaattatttcggctctctcacgcaagcgtctacttgcagaattggatccttcaatggtgaagagatttatgctccatttaagagcctgctccccatggtggatcctaacgatattgtgtttggaggatgggacataaacgacatgaatttggcggacgccatggcccgggctaaggtgcttgacatcgatctccagaaacaactgcgaccttacatggaaagtatggttccactccctggagtctatgatccggacttcatagctgcaaaccaaggctctagagcaaataacattatcggagggaccaaaaaagaacaggtgcagaaaattgtccaagacataagagaattcaagaccaaaacaaatgtggagaaagtggttgtactctggacggctaataccgaacgatttagcaacgttgtagtggggctgaatgatacagaagaaaatttgcttgcatctgttgagaggaacgagtcagagattgcaccatcgaccttatatgcgttggcttgtgttcaggagaatgttcctttcatcaatggaagccctcaaaacacctttgttccaggtctgatagatttggctgtttcgaaaaacactcttattggaggtgatgattttaaaagtggccagacaaagataaagtccgtgcttgtggatttccttgttggtgctggtatcaagccaacctccattgtgagttacaatcaccttggaaacaacgatgggatgaatctgtctgctccacagactttccggtcaaaggaaatttcaaagagcagtgttgtagatgacatggtttccagcaatgcaattttgtatgaacctggtgaacatcctgaccatgttattgttatcaagtatgtcccttatgttggagatagcaagagggccatggatgagtatacatctgagatctttatggggggaaggaacacaattgtaattcacaacacctgtgaagactctttgcttgcagctcccataatcttggacttggtcttacttgctgaactttgcaccaggatcaagcttaagaaagagggggaggggaagttccactctttccatccagtggcaagtattttgagctatctaacaaaagctccacttgttcctcctggcacgcctgtggttaatgccctagcaaagcagagggcaatgctagagaacatcctcagggcatgtattggattggctcctgagaacaacatgctcctcgaatacaagtagagcctcatcgcttagcgtgaagcagagcatgggactgttttagaaggatgaccattttggttgcaacaaacattttcttgtttcatttaagaaagtattattaccaacagagcctctcaagataacttcaagaggtcttgtttatacataatatgtggttcaaaatttttaatgcttttgtttatttttggtatgagtaaaacactgttcataggtttgcagagttaaaaaatagtggaacttatgggaaagagaaagggagagaaaggtggtgatgaatgcaataggcttgtgcttttcttggatttgcttgtttatatatatatatatatgaaaaactttga

SEQ ID NO: 597 - DNA, 2096 bp, Pine
ctccagcagtgtgaggaggagagtgaggcagagttagtgtgaggaggagactgaagcagagtttcggtggtctgccaattttctgtgtgcaatttctaatctaggcagagggctttccatattctttccttgttccgcgcacgattcttgggcgtaatcaaagctattatccagtccctccatcgcctgttattacctttccccttttctactttcgaaagatgtttatccagagcttccgcgttgacagccccaacgttaattactctgaggaaagcatcgactcgatctatgactaccagacgaccgagctcgtgcacgaaaatgccaatggcaaatatgagtgggtggtcaagcccaagaccgtgcgatacgagttcaaaacggagagacgggtccccaagctcggggtcatgctcgtcggatggggaggaaacaatggttccacgctcacggcgggtgtgattgcgaacagagaaggaatctcctgggtgacgaaggaaaaagtacagcaggcaaattatttcggttccctcacgcaagcttcgacctgcagaatcggatcctttaacggcgaagagattcatgctcctttcaagagccttcttccaatggtggatcctaatgcaatcgtctttggtggatgggacataaacaacatgaatctagcggatgccatggcccgagccaaggttcttgacattgacctacagaagcagctgcggccctacatgcaaggcatgactcctcttcctggtatatatgacccggatttcatagcggcaaaccagggtgagagggcaaataatgtgatcaaaggctccaagaaagagcaactgcaaaagattatccaagatatcagagattttaaatcgaaaacaaaggtggacaaggtagtcgtactgtggactgctaataccgaacgatacagcgacgttatcgtgggtttaaatgacacgaaggaaaccctgcttgcttctctggaaagaaatgagtccgaaatctcgccatcgactctctacggcttggcctgcgttcaggagaacgttcccttcataaacggcagtcctcaaaacaccttcgttccaggattgatcgatttagcaattacaaagaacagtatcatcgcaggagatgacttcaagagcgggcagacaaagatgaagtcggtactcgtggatttcttagtcggtgccggtcttaagccaacttcgattgtgagctacaatcacctcggtaacaacgacgggatgaatctgtcagctccccagactttccggtcaaaggaaatttcaaagagcaatgtcgtcgacgacatggttgccagcaacgccattctttacgaaccaggggaacacccagaccatgtcgtcgtcatcaagtatgtaccttacgttggagacagcaagagagccatggacgagtacacgtccgagatatttatgggaggaaaaaacacccttgtcatccacaatacatgtgaagattcgcttcttgcagctcctctgatcttagacttggtgttgctcgccgaactctgtaccaggattcaacttaaaaaggaaggcgaggggaaattccattctttccacccggtagcaagcattttaagctacctcaccaaagcgccactggtaccaccaggcacgcctgtcgttaacgccctggcgaagcagagggcgatgctggagaacatcatgagggcctgcgtcggcctcgctcccgaaaacaacatgaccctcgaatacaagtgaattgctgtggtcaggtcgacatcctaagtggcatgggtttattcatcgtactgatgaagaagaaaaacagggtggtccactcgaatgagcatctacagtgtttctggtatccttttgtaataaaacctacctgatgtcgtgttgttatgccatataattttacggtcccaagtcgtttgtgattaataataagcgattgtagaagtgtgacttgttaaaaagttttcgaaccaagatgaagcgtatatgttcattttggtgattgttaataaaatacaactttttcataaaagaaaaacacgactggatgaataaccttgtcggccgcctcggcccagtcaa

SEQ ID NO: 598 - DNA, 2036 bp, Pine
ggcacactaccaactccagcagtgtgaggaggagagtgaggcagagttagtgtgaggaggagactgaagcagagtttcggtggtctgccaattttctgtgtgcaatttctaatttaggcagagggctttccatattctttccttgttccgcgcacgattcttgggcgtaatcaaagctattatccagtccctccatcgcctgttattacctttccccttttctactttcgaaagatgtttatccagagcttccgcgttgacagccccaacgttaattactctgaggaaagcatcgactcgatctatgactaccagacgaccgagctcgtgcacgaaaatgccaatggcaaatatgagtgggtggtcaagcccaagaccgtgcgatacgagttcaaaacggagagacgggtccccaagctcggggtcatgctcgtcggatggggaggaaacaatggttccacgctcacggcgggtgtgattgcgaacagagaaggaatctcctgggtgacgaaggaaaaagtacagcaggcaaattatttcggttccctcacgcaagcttcgacctgcagaatcggatcctttaacggcgaagagattcatgctcctttcaagagccttcttccaatggtggatcctaatgcaatcgtctttggtggatgggacataaacaacatgaatctagcggatgccatggcccgagccaaggttcttgacattgacctacagaagcagctgcggccctacatgcaaggcatgactcctcttcctggtatatatgacccggatttcatagcggcaaaccagggtgagagggcaaataatgtgatcaaaggctccaagaaagagcaactgcaaaagattatccaagatatcagagattttaaatcgaaaacaaaggtggacaaggtagtcgtactgtggactgctaataccgaacgatacagcgacgttatcgtgggtttaaatgacacgaaggaaaccctgcttgcttctctggaaagaaatgagtccgaaatctcgccatcgactctctacggcttggcctgcgttcaggagaacgttcccttcataaacggcagtcctcaaaacaccttcgttccaggattgatcgatttagcaattacaaagaacagtatcatcgcaggagatgacttcaagagcgggcagacaaagatgaagtcggtactcgtggatttcttagtcggtgccggtcttaagccaacttcgattgtgagctacaatcacctcggtaacaacgacgggatgaatctgtcagctccccagactttccggtcaaaggaaatttcaaagagcaatgtcgtcgacgacatggttgccagcaacgccattctttacgaaccaggggaacacccagaccatgtcgtcgtcatcaagtatgtaccttacgttggagacagcaagagagccatggacgagtacacgtccgagatatttatgggaggaaaaaacacccttgtaatccacaatacatgtgaagattcgcttcttgcagctcctctgatcttagacttggtgttgctcgccgaactctgtaccaggattcaacttaaaaaggaaggcgaggggaaattccattctttccacccggtagcaagcattttaagctacctcaccaaagcgccactggtaccaccaggcacgcctgtcgttaacgccctggcgaagcagagggcgatgctggagaacatcatgagggcctgcgtcggcctcgctcccgaaaacaacatgaccctcgaatacaagtgaattgctgtggtcaggtcgacatcctaagtggcatgggtttattcatcgtactgatgaagaagaaaaacagggtggtccactcgaatgagcatctacagtgtttctggtatccttttgtaatagaacctacctgatgtcgtgttgttatgccatataattttacggtcccaagtcgtttgtgattaataataagcgattgtagaagtgtgacttgttaaaaagttttcgaaccaagatgaagcgtatatgttcattttggtgattgttaa

SEQ ID NO: 599 - DNA, 1981 bp, Spruce
gaaacgatcttcgaaaatattattcgtggtttttggcggaggacgcgaggcggtttggaggcgaggagcaggctccgcctttggcgctggtgcgatttctaattcaggcacctttcctggtttctctcatcttgtctcttctctgtgccgtgtggtagagatgtttatccagagcttccgcgtcgagagccccaacgtcaagtattctgaggaaagcattgactcgatctatgactatcagacgaccgagctcgtacacgagaatgttaatggcaaatacgagtgggtcatcaagccgaagagcgtgcgatacgaattcaaaaccgagaggcgggtccccaagcttggggtcatgctagtcggatggggaggaaacaacggctccacgctcacggcgggtgtgattgcaaacagattaggaatctcatgggtgacgaaggaaaaaatacagcaggcgaattacttcggttccctcactcaagcttcgacctgcagaatcggatccttcaaaggcgaagagattcatgctcctttcaaaagccttcttccaatggtggatcccaatgacattgtctttggcggatgggacataaacaacatgaatctcgcggacgccatggcccgagccaaggttcttgatattgacctccagaagcagctgcggccctacatgcaaggaatgaatccccttcctggtatctatgacccggatttcatagcggcaaatcaaggtgagagggcaaataatgttgtcaagggctccaagaaggagcaagtgcaaaagattatccaagatatcagagatttcaaatcgaaaacaaaggtggacaaggtagtcgtactgtggactgctaatactgaacgatacagcgatgttatcgtgggttttaatgacacaaaggagaccctgcttgcttctctggaaagaaatgagtccgagatctcgccatcgactctctacggcttggcctgcgttcaggagaacgttcccttcataaacggcagtcctcaaaacaccttcgttccaggcttgatcgatttagctattacaaagaatagtatcatagcaggagacgacttcaagagcgggcaaacaaagatgaagtctgtgctcgtggatttcctagtcggtgcgggtcttaagccaacttcgattgtgagctacaatcaccttggtaacaacgatgggatgaatttgtcggctccacagactttccgttcaaaagagatttcaaagagcaatgttgtggacgacatggttgccagcaacgccattctttatgaaccaggggaacacccagaccatgtcgttgtcataaagtatgtgccttatgttggagacagcaagagagccatggacgagtacacgtctgagatcttcatgggagggaagaacacccttgtaatccacaatacatgtgaagattcactgctcgcagctcctctgatcttagacttggtgttgctcgccgaactttgcactaggattcaacttaagaaggaaggcgaggggaaattccactctttccatccagtagcaagcattttaagctacctcaccaaagcaccactggtaccacctggcacacccgtcgttaacgccctagcaaagcagagggcgatgctggagaacatcatgagggcatgcgtcggcttggctcctgagaacaacatgaccctcgagtacaagtgaagcgatggcgtctagtcgacatcccaagtggcatgggttcattcattggactgatgaagaagaaaaacacggtggtccatgcaaactagcatctacagtggttctggtacctttttgtggaaattcgtctacgtgatgtcgtcttgttatgacacataatgttacggtccaagttgtttgtgattaataataagcgattgtagcaatatgacctgtttataggtcttttcaaccaagatgaagagtatatgtgttcgttttggtgattatcaataaaatacaactttt

SEQ ID NO: 600 - DNA, 2698 bp, Spruce
acactaccagctgccgcagtgtgaggaggagagtgaaccactggttcagtgatctgccattttctgatccacggtggtcgttacgatttgtgcactgattttcgctttgctgcccgtttggcgcaagttggctctgatttctgcaagttttaggctcatctctcttgcgtagggatagagtgattctctcgatttactctaaataaaccgctgggaacttccatttcgtttgcaattatttccccaatccatttcgctcctatacaaacgggtggggtttttgcatcccgcgtgcaggaatccaccccgaattcactcctgtgcgatttctttttcaagcacacggggttttccatattcttgcctcgctccgccctcgattctttggaataacaaaatatattatcaagtctctgcctcgcttgtttctacccttagccttttcttctttccttgatcgcgtctcttctctgtgccgtgtggtagagatgtttatccagagcttccgcgtcgagagccccaatgttaagtactctgaggaaagcatcgactcgatctatgactaccagacgaccgagctcgtgcacgagaacgttaatggcaaatacgagtgggttgtcaagccgaaggccgtccgatacgagttcaaaaccgagaggcgggtccccaagctcggggtcatgctagtcggatggggaggaaacaatggctcaacgctcacggcgggtgttattgcaaacagagaaggaatctcgtgggtgacgaaggaaaaggtacagcaggcaaattacttcggttccctcacgcaagcttcgacctgcagaatcggatcctacaaaggcgaagagattcatgctcctttcaagagccttcttcccatggtggatcctaatgacattgtctttggcggatgggacataaacaacatgaatctcgcggacgccatggcccgagccaaggttcttgatattgacctccagaagcagctgcggccctacatgcaaggcatgagtcctcttcctggcatctatgacccggatttcatagcggcaaaccaaggtgagagggcaaataatgttctcaaaggctccaagaaggagcaagtgcaaaagattatccaagatatcagagatttcaaatcgaaaacgaaggtggacaaggtagtcgtactatggactgctaataccgaacgatacagcgatgttatcgtgggtttgaatgacacaaaggagaccctgcttgcttctctggaaagaaatgagtctgagatctcaccatcgactctctacggcttggcctgcgttcaggagaatgttcccttcataaacggcagtcctcaaaacaccttcgttccaggcttgatcgatttagcaattacaaagaacagtatcatcgcaggagacgacttcaagagcgggcaaacaaagatgaagtcggtgctcgtggatttcctagtcggtgcaggtcttaagccaacttcgattgtgagctacaatcacctcggtaacaacgacgggatgaatctgtcggctcctcagactttccgttcaaaggagatttcaaagagcaatgtcgtggacgacatggttgccagcaacgctattctttacgaaccaggggagcacccagaccatgtcgtcgtcatcaagtatgtgccttacgttggagacagcaagagagccatggacgagtacacgtccgagatcttcatgggaggtaaaaacaccctcgtaattcacaatacatgcgaagattcactacttgcagctcctctaatcttagacttggtgttgctcgccgaactctgcaccaggattcagcttaagaaggaaggcgaggagaaattccactctttccacccggtagcaagcattttaagctacctcactaaagcaccgctggtgccacctggcacgcccgtcgtgaacgccctagcaaagcagagggcgatgctggaaaacatcatgagggcatgcgtcggcctggctcccgagaataacatgaccctcgagtacaagtgaagcgctggcgccaagtcggcatcccaagtggcatgggttcattcatcggattaatgaagaagaaaagacggtggtccacgcaaactagcacatacagtggttctggtaccttttcgtggaaatatgtctacgtgatgtcgtcttgttctggcatataatgtggttgttctggcatacaatgtggtgtcgtcttgttatggcatataatgttacggtccaacttgtttgtgattaataataagcgattgtataagtatgacccgtttataagtcttttcgaaccaagatgaagagaagtatgacctgtttataagtcttttcgaaccaagatgaagagtatatgttcattttggtgattatcagttaaatacaactttttcaacttaatatctcttttgtattattgtattaccggtttggcttatctctttataagccatctatctctttataggccaatctacttctaagcttaatgtgtttaacttaatccgtgcaggctttatctctttataggccaatctacttctaagctttatgtgtttaacttgatccgtgcaggctttaccttctggaccaacacagagcgtaaatcatctgcctcccaaaacatctagacagttcactaaaacttttgccctaccaaagttttaactggttaattcatctcatgctag

SEQ ID NO: 601 - DNA, 2660 bp, Spruce
cccccccgggcacactaccagctgccgcagtgtgaggaggagagtgaaccacaggttcagtgatctgccattttctgatccacggtggtcgttacgatttgtgcactgatttccgctttgctgcccgtttggcgcaagttggttctgatttctgcaagttttaggctcatctctcttgcgtagggatagagtgattctctcgatttactctaagtaaaccgccgggaacttccatttcgtttgcaattatttccccaatccatttcgctcctatacaaacgggtggggtttttgcatcccgcgtgcaggaatccaccccgaattcactcctgtgcgatttctttttcaagcacacggggttttccatattcttgcctcgctccgccctcgattctttggaataacaaaatatattatcaagtctctgcctcgcttgtttctacccttagccttttcttctttccttgatcgcgtctcttctctgtgccgtgtggtagagatgtttatccagagcttccgcgtcgagagccccaatgttaagtactctgaggaaagcatcgactcgatctatgactaccagacgaccgagctcgtgcacgagaacgttaatggcaaatacgagtgggttgtcaagccgaaggccgtccgatacgagttcaaaaccgagaggcgggtccccaagctcggggtcatgctagtcggatggggaggaaacaatggctcaacgctcacggcgggtgttattgcaaacagagaaggaatctcgtgggtgacgaaggaaaaggtacagcaggcaaattacttcggttccctcacgcaagcttcgacctgcagaatcggatcctacaaaggcgaagagattcatgctcctttcaagagccttcttcccatggtggatcctaatgacattgtctttggcggatgggacataaacaacatgaatctcgcggacgccatggcccgagccaaggttcttgatattgatctccagaagcagctgcggccctacatgcaaggcaggagccctcttcctggcatctatgacccggatttcatagcggcaaaccaaggtgagagggcaaataatgttctcaagggctccaagaaggagcaagtgcaaaagattatccaagatatcagagatttcaaatcgaaaacgaaggtggacaaggtagtcgtactatggactgctaataccgaacgatacagcgatgttatcgtgggtttgaatgacacaaaggagaccctgcttgcttctctggaaagaaatgagtctgagatctcaccatcgactctctacggcttggcctgcgttcaggagaatgttcccttcataaacggcagtcctcaaaacaccttcgttccaggcttgatcgatttagcaattacaaagaacagtatcatagcaggagacgacttcaagagcgggcaaacaaagatgaagtctgtgctcgtggatttcctagtcggtgcaggtcttaagccaacttcgattgtgagctacaatcacctcggtaacaacgacgggatgaatctgtcggctcctcagactttccgttcaaaggagatttcaaagagcaatgtcgtggacgacatggttgccagcaacgctattctttacgaaccaggggagcacccagaccatgtcgtcgtcatcaagtatgtgccttacgttggagacagcaagagagccatggacgagtacacgtccgagatcttcatgggaggtaaaaacaccctcgtaattcacaatacatgtgaagattcactacttgcagctcctctaatcttagacttggtgttgctcgccgaactctgcaccaggattcagcttaagaaggaaggcgaggggaaattccactctttccacccggtagcaagcattttaagctacctcactaaagcaccgctggtgcctcctggcacgcccgtcgttaacgccctagcaaagcagagggcgatgctggagaacatcatgagggcatgcgtcggcctggctcccgagaataacatgaccctcgagtacaagtgaagcgccggcgccaagtcggcatcccaagtggcatgggttcattcatcggactaatgaagaagaaaagacggtggtccacgcaaactagcatctacagtggttctggtacctttttgtggaaaggtgtctacgtgatgtcgtcttgttctggcatataatgtggttgttctggcatataatgtggtgtcgtcttgttatggcatataatgttacggtccaacttgtttgtgattaataataagcgattgtataagtatgacccgtttataagtcttttcgaaccaagatgaagagaagtatgacctgtttagaagtcttttcgaaccaagatgaagagtatatgttcattttggtgattatcagttaaatacaactttttcaacttaatctctcttttgtattattttattaccggtttggcttatctctttataagccatctatctctttataggccaatctacttctaagcttaatgtgtttaacttaatccgtgcaggctttatctctttataggccaatctacttctaagctttatgtgtttaacttgatccgtgcaggctttatcttctggaccaaacacagagcgtaaatcatctgtctcacaaaacatctagacagttcact

SEQ ID NO: 602 - DNA, 2176 bp, Cedrus
tggagagtgaaccttggtaatctgccattttctgctccacggcagtggatccgattctttaactgattttggcttggctgcctgtttggcgcgagcagttgctcccatttctgcggtgattttcgcttgatttatggccgacctgtgcgatttctaattgagaaacgaagttttccatatttccgcttcgttctgcgcacgattcctcggaataaccaaatatattatccagtatctgccttgcctgttattaaccttggccttttgcagctttaccccatctcgtctattctctgtgctgtggtaaaaatgtttatccagaacttccgtgttgagagccccaacgtcaagtactctgaggatagcatcgactcgatctatgactaccagacgaccgagcttgtacacgaaaatgttaatggcaaatacgagtgggttgtcaaaccgacgagcgtgcgatatgagttcaaaacggagaggcgggtccccaagctcggggtcatgcttgtcggttggggaggaaacaacggatccacgcttacggctggtgtgatagcaaacagagaaggaatctcgtgggtgacgaaggaaaaagtacagcaggcaaattacttcgggtccctcacccaggcttcgacctgcagaatcggatccttcaaaggcgaagagattcatgctcctttcaaaagtcttcttccaatggtggatcctaatgacattgtctttggcggatgggacataaataacatgaatcttgcggacgccatggcccgagccaaggttcttgatattgacctccagaagcagctccggccctacatgcaaggcatggctcctcttcctggtatctatgacccggatttcatagcggcaaaccaaggtgagagggcaaataatgttctcaagggttccaagaaggagcaggtgcaaaagattatccaagatatcagagatttcaaatcgaaaacaaaagtggacaaagtagtcgtactgtggactgctaataccgaacgatacagcgacgttatcgtgggtttgaacgacacaaaggagaccctgcttgcttctctggaaagaaacgagtccgagatctcgccatcgactctctacggcttggcctgcgttcaggagaacgttcccttcataaacggcagtcctcaaaacactttcgttccaggcttgatcgatttagcaattacaaagaacagtatcatagcaggagacgacttcaagagtggacagacaaagatgaagtcggtgctcgtggatttccttgtcggtgcgggtcttaagccaacttcgattgtgagctacaatcacctcggtaacaacgacggaatgaatctatcggctccgcaaactttccgttcaaaagagatttcaaagagcaatgtcgtggacgacatggttgccagcaatgccattctttacggaccaggggaacacccagaccatgtcgtcgtcatcaagtatgttccttacgttggagacagcaagagagccatggacgagtacacgtccgagatcttcatgggagggaagaacactctcgtaatccacaatacatgtgaagattcactgcttgcagctcctctgatcttagacttggtgttgctcgctgaactctgcaccaggattcagcttaagaaggaaggcgaggggaaattccattcattccacccggtagcaagtattttgagctatctcaccaaagccccgctggtaccacctggaacgcccgtccttaacgctctggcaaagcagagggcgatgctggagaacatcatgagggcatgcgttggcctggctcccgagaacaacatgaccctcgagtacaagtgaagcgctggcgccaagtcggcatccccagtggaatgggtacatcgatcggacttctgaagaagaaaaacacgtttgttcttctggtactttttgcgtaaagacgtcttcgtgacgtcttattatgacatatattgttacatttcaagttgtttgtgattaatagtaagcgattgtagaagtatgacatgttaataagtcttttcgaaccaaaatgaagagtatatactcattttggataactttttcaatctgatatctcttatgtattattgtattatctgtttcggcctttctttttataaggcatctacttctaagctttacgtgtttaaca

SEQ ID NO: 603 - DNA, 2030 bp, Gnetum
aagcggcaggttccttttcagcttagctgttcgctcccttttggcgctctttcgtgtcggtttctgcaactcacagcttggcttgctcccgttccgcttccgattgttcttgaggcattttgtgttgggagttttctttctcagcgaagatgttcatcgagaacttccgcgttgagagccccaacgtgacctacaccgaggagagcatcgaatcggtgtacggctaccagacgacggagcttgtgcatgagaaccgcaatggcacgtaccagtggatcgtgaggcccaaggaagtcaagtatgagttcaagaccgaccgccaagtgcctaagctaggggttatgctagtagggtggggtggaaataacggctgcacgctgactgccggggtaatcgctaacagagaaggaatctcctgggtgaccaaggacaaggtacagcaggcgaactacttcggctctcttacgcaggcctcgacgtgcaggatcggctcttacaatggagaggagatctacgctccattcaagagccttttgcctttggtggatcccaacgatatagtgtttggcggatgggacatcagcaacatgaacttggcggatgcgatggctcgggccaaggtcctggaaatggacctacagaagcagctgcgtccctacatgcagggaatgacccctctgccgggcatctacgatccggacttcatcgcagcgaaccagggcgagagggccaacaacatcgtgaagggctccaggaaggagcagatgctgaagattattcaggatatcagagaattcaaggcgaacacgaaggttgacaaggttgtggtcctgtggaccgctaacactgaacgatacagcaatgtagtggtgggtttgaatgacacgaaggagaatctgttggctgcattggacagaaacgaattggaaatttctccgtccacaatctacgccatagcttgcgtcctggagggcgtccctttcatcaatggcagtcctcagaacactttcgtccctgggttgattgacttggctgtcgagaagaacagcctcatcggcggagatgatttcaagagtggccaaaccaagctcaagtccgtgctcgtggatttcctcgtgggagctggtcttaagccgacctccatcgtgagctacaaccacctgggaaacaacgacggcatgaatctctcggcgccacagaccttccgttccaaagagatctccaagagcaatgtggtggacgacatggtctccagcaacgccatcctctacgagcaaggcgagcatcccgatcacgttgtggtcatcaagtatgtgccttacgttggggacagcaaacgagccatggatgagtacacctccgaaattttcatgggaggcaagaacacgctggttattcacaacacctgcgaagattccctgcttgctgcgcccttaatcctcgatctggtgctcctcgctgagctctgcactaggattcaactcaagaaagaaggcgaggccaagttccattcattccacccggtggcaagtcttctgagctaccttacaaaggctccactggttcctcctggcacaccagtggtaaacgctctggcaaagcagagggccatgctggagaacgtgatgagggcttgcgtgggactggctccggagaacaacatgaccctcgaatacaagtgaagtcttatgcaattgtggaagggacccggtttctgtttctgttcagcgcactgttagaaatcatttgcaatttggaaactggtctactgctgtctcctttcccgtcttctctcttgtcttctctctgtagccgtatatacagacatcttcatctggtaacctgaattttagattctgtggcttacgcctgtcgcacaccgacaattatgtaaggcacggcgcacattgattgatgtattaagggtacaatgtatgtcatgtcgtctaggtaattgatgaaatatttttaaactggactttgggagtttatggtgattttaaaaacatggcgctataatgaatggaata

SEQ ID NO: 604 - DNA, 2080 bp, Abies
tagtatcagcagtgtgagaggagagtgaactagagattcgtctaaccttaggccaattcgatttcttgcacctacgattctttcgcctagcttgcccttttgtctaaacttccatttaatttttccgccagttctggccgaactgtgcgatttctaattcaggctcggagttttcaatattctcgcctcagtccgcgctcgattcctgggaatctcaaatatattatccagtcggtaccttacctattattattacccttagcatttgctactttgcctgatctcgtctctcctctgtgccgtgtggtaaaaatgtttatccagagcttccgcgtcgagagccccaacgtcaagtactctgaggaaagcatcgagtcggtctatgactaccagacgaccgagctcgtgcacgagaatgttagtggaaaatatgagtgggtcgtcaagccgaagagcgtgcgatacgagttcaaaaccgataggcgggtccccaagctcggggtcatgcttgtcggatggggaggaaacaatggctccacgctcacggcgggcgtcattgcaaacagagaaggaatctcgtgggtgacgaaggaaaaagtacagcaggcaaattactttggctcacttactcaggcttcgacctgcagaatcggatcctttaaaggcgaggagattcatgctcctttcaagagcctgcttccattggtggatcctaatgacattgtgtttggcggatgggacataaacaacatgaatctggcggacgccatggcccgagcgaaggttcttgatattgatctccagaagcagctgcggccctacatgcaatgcatgagtcctcttcccggtatctatgacccggattttatagcggcaaaccaaggggagagggcaaatcatgttctcgagggttccaagaaggagcaggtgcaaaagattatccaagatatcagagatttcaaatcggaaacaaaggtggacaaagtagtcgtactgtggacagctaataccgaacggtatagcgacgttatcatgggtttgaacgacacaaaggagacccttcttgcttctctagaaagaaacgaatccgagatctcgccatcgactctctatggcttggcctgcgttcaggagaatgttcccttcataaacggcagccctcaaaacaccttcgttccaggtttgatcgatttagcaattacaaagaatagtatcatagcaggagacgactttaagagtgggcaaacaaagatgaagtcggtgcttgtggatttcctagtcggtgcgggtcttaagccaacttcgattgtgagctacaatcacctcggtaacaacgacgggatgaatctgtcggccccgcagactttccgttcaaaggagatttccaagagcaatgtcgtggacgacatggttgccagcaacgccattctttacgaaccaggggaacacccagaccatgtcgtcgtcatcaagtatgtgccttacgttggagacagcaagagagccatggacgagtacacgtccgagatcttcatgggagggaagaacaccctcgtaatccacaatacatgtgaagattcgctgcttgcagctcctctgatcttagacttagtgttgctcgccgaactctgcaccaggattcagctgaagaaggaaggcgaggggaaattccattctttccacccagtagcaagcattttgagctaccttaccaaagccccgctggtaccacctggcacgcccgtccttaacgcgctggcaaagcagaggtcgatgctggagaacatcatgagggcatgcgtcggcctggctcccgagaacaacatgaccctcgagtacaagtgaagcgctggcgccgagtcggcatcctaagtggcatgggttcattattcatcggacttctgaagaagaaaaacacattggttcacgcagccgagcctctacggtggttctggtacctttttgtggaaagatatctacgtgacgttttgttatggcatataatgttacggtccaggttgtttgtgattaataataagggatttcgaaccaaaatgaagaatatatgctcattttggtg

SEQ ID NO: 605 - DNA, 2094 bp, Brachypodium
agaagatgttcgtggaggggttcaaggtggagagcccgcatgtgcggtacggcgccggcgagatcgagtccgagtaccgctacgacaccacggaggtcgcgccgtcgcccgaggggacgggctgggtggtgcgccccaagtcagtcacctacaacttcaagaccagcaccgccgtccccaagctcggggtgatgcttgttggatggggcggcaacaacggcaccactctcacagccggggtcatcgccaacagattggccatttcatgggcgaccaaggagaaggtgcagaaggccaactatttcggctctctaacccaggcttcagccatcagagttggcagctacaatggagaggagatctacgcacctttcaagagccttgtacccatggtgaatccgaacgacattgtgtttggtggatgggacatcagcagcttgaacttggccgacgccatgggtagggccaaggtgttggacattgacctgcagaaacagttgagggtctacatggagtccatggtgcccctccccggcatctacaacccggacttcatcgccgccaaccagggctctcgcgctaacaatgtcatcaaaggcaccaagaaggagcaggttgagcagatcatcaaggatatcagggagttcaaggagaagaacaaggtggacaaagtggtcgtgctgtggacggccaacaccgagcggtatagtgacgtcgtcgtcgggctcaacgacaccatggacaacctcttggcttctctggacaagaacatggccgagatctcaccgtcatcgatgtacgcaatagcctgcgtcacagaggggataccattcatcaatgggagcccccagaataccttcgttccggggttgattgagctcgccatcaagaagaactcgttgattggtggtgatgacttcaagagtgggcaaaccaagatgaagtctgtcctggttgacttccttgtcggtgctggaatcaagcccacctcaattgccagctacaaccatctgggcaacaacgatggcatgaacctctcggctccacaggtattccggtccaaggagatctcaaagagcggcgtggtggatgacatggtggccagcaacggcatcctctacaaccccggggagcacccggaccacgtcattgtcatcaagtatgtgccgtatgttggcgacagcaagagggccatggacgagtacacctccgagatcttcatgggtgggaggaacaccatcgtgctgcacaacacctgcgaggactcactcctcgccgcgcccatcatcctagacctcgtgctcctagccgagctcagcaccaggatccagctcaaagcccaaggccaggaaaagttccactcattccacccggtggccaccatcttgagctacctcagcaaggcccctcttgttcccccagggacaccagtggtgaatgcactggccaagcagagggccatgctggagaacatcctgagggcctgtgttgggctggcccctgagaacaacatgatgcttgagcacaagtgacattgcccagcaaaattctctcgtcacaagggaaaggagaacaagtatcaccacatcaaggaataactagaggccagtggaaggagagatcaggtcaaacatggtgtcaagtcacttggaccctcttggggctttaagttcattagttagtttgccctccgctccctgtgttttcacagctgtttaggaaatttttggtgatgggactggtcatgtatgatagggtcgaaggaattagtcatcgtctttagttacatttgcttattatggagctggtagaagtggtcagcctaatatttggaacttttaatcaaagaacggcttgctccttgtttggatcatgctttgccctatccttttcactgctcggcgagaactcctttttctggcttcagggcagtatttttctagtataatttttcaatagccctcatgaactttgtaaaggataaggaagagactactttccacctatgcagcagagaatatgcaacaggagcatgaagttcacatgtaaattttcaatcaatatatcaccgcaatctgatgcagtcacgaaaaa

SEQ ID NO: 606 - DNA, 1880 bp, Taxus
tgctataaaaggagcacactgacataaatttattagcaccagcatcatcgaccaatttcaggccgcatttttatttcaatctgggaaaatgtttgttgagaggtttcgcgtgcagagccctaatgtgaaatataatgaggagagtatagagtccgtgtatgactatgaaacaactgagcttgttcatcagaacacaaatggaaagtatgaatgggtcgtcatacccaagtctgtcagataccacttcaacactcacacgcgggtccccaagctcggggttatgctggtgggatggggaggaaacaatggctccaccctaaccgcaggtgttattgccaatagagagggaatctcttgggtaacaaaggagaaggtacaacaggcaaattatttcgggtctctcacccaagcatccacttgcagaattggatcttataatggcgaagagattcatgctcctttcaagagcctccttcccatggtggaccccaacgatattgtatttggcggatgggacatcagcaacctgaatttggcggatgccatggctcgagccaaggtgctagacattgacctccagaagcagctgcgaccctacatgcaagacatggtgcctcttcctggaatttttgatcctgatttcatagccgcaaaccaaggtgaaagggcaaataatatcatcaagggttccaagaaggaacaggtgcagcaaattgttcaagacattacggagttcaaggtgaaaacaaaggtggacagagtagttgttctttggactgcaaatacagaacgatacagcaatgttatggtgggtctgaatgacacaaaggagaccctgttagcatctctggaaagggatgaatctgagatctcgccctcgactctttatgctctggcttgtattcaggagaatattcccttcatcaatggcagtccccagaacacctttgtaccaggtctgatagaatttgccattgagaagaacagtctcattggaggggatgatttcaagagtggtcagacaaagatgaagtctgtgcttgtggatttcctcgttggtgctggcatcaagccaacagccattgtgagctacaatcatttgggaaacaatgacgggatgaatttgtcagctccacagactttccgttctaaggaaatttcaaagagcaatgtagtagatgacatggtttcaagcaatgccattttgtatgggcctggcgaacaccctgatcatgtgatcgtcatcaagtacgtgccctatgttggagacagcaagagagccatggatgaatacacttctgagattttcatgggagggaagagcaccatcgtactccacaatacctgtgaagactccttgcttgcagctcctttaatcttggatttggtcttacttgctgaacttagcaccaggattcagcttaagaaagagggcgaggctaaatttcactctttccaccctgtagcaactattctgagctaccttaccaaagccccattggttccccctggtacccctgtggtgaatgccctggcaaagcagagggctatgctagagaacataatgagggcatgcattggactgtcgcctgataataacatgatcctggagtacaagtgaaaggcataggctggttcagacggacagcccggggtcatgcgtgctaagttttagggttttgaatgagctagctgatcctcattttgtgtttcctgattctctgtggctaataaagttaaactggtgtatggcatgaaattgtgtttccattatggctggtgattactaataccaagaaagctttttctttcccgttgtattggaacattcttaccttccataaaggttaatgacaatgtgttattgcgtcttagttacc

SEQ ID NO: 607 - DNA, 1952 bp, Pine
tgtgcaatttctaatttaggcacagggctttccatattctttccttgttctgcgcacgattcttgggcgtaatcaaagctattatccagtctctccatcgcctgttattacctttccccttttctactttgctgatctcgtctcctctgtgctgtctggtaaagatgtttatccagaacttccgcgttgagagccccaacgttaagtactctgaggaatgcatcgactcgatctatgactaccagacgaccgagctcgtgcacgagaatgccaatggcaaatatgagtgggtggtcaagcccaagaccgtgcgatacgagttcaaaacggagagacgggtccccaagctcggggtcatgctcgtcggatggggaggaaacaatggttccacgctcacagcgggtgtgattgcgaacagagaaggaatctcgtgggtgacgaaggaaaaagtacagcaggcaaattatttcggttccctcacgcaagcttcgacctgcagagtcggatcctttaacggcgaagagattcatgctccttttaagagccttcttccaatggtggatcctaatgcaatcgtctttggtggatgggacataaacaacatgaatctggcggatgccatggcccgagccaaggttcttgacattgacctacagaagcagctgcggccctacatgcaaggcatgaatcctcttcctggtatatatgacccggatttcatagcggcaaaccagggtgagagggcaaataatgtcagaaagagcagctgcaaaagattatcgaagatatcagagattttaaatcgaaaacaaaggtggacaaggtagtcgtactgtggactgctaataccgaacgatacagcgatgttatcgtgggtttaaatgacacaaaggaaaccctgcttgcttctctggaaagaaatgagtccgaaatctcgccatcgactctgtacggcttggcatgcgttcaggagaacgttcccttcataaacggcagtcctcaaaacaccttcgttccaggattgatcgatttagcaattacaaagaacagtatcatcgcaggagatgacttcaagagcgggcagacaaagatgaagtcggtactcgtggatttcctagtcggtgccggtcttaagccaacttcgattgtgagctacaatcacctcggtaacaacgatgggatgaatctgtcagcaccccagactttccgatcaaaggaaatttcaaagagcaatgtcgttgacgacatggttattctttacgaaccaggggaacacccagaccatgtcgtcgtcatcaagtatgtaccttacgttggagacagcaagagagccatggacgagtacacgtccgagatattcatgggaggaaaaaacaccctcgtaatccacaatacatgtgaagattcgcttcttgcagctcctctgatcttagacttggtgctgctcgccgaactctgtaccaggattcaacttaaaaaggaaggcgaggggaaattccattctttccacccggtagcaagcattttaagctacctcaccaaagcgccactggtgccaccaggcacgcctgtcgttaacgccctggcgaagcagagggcgatgctggagaacatcatgagggcctgcgtcggcctcgctcccgaaaacaacatgaccctcgaatacaagtgaattgctggggtcagatcgacatcctaagtggcatgggtttattcatcggactgatgaagaagaaaaacagggtggtccactcgaatgagcagctacagtgtttctggtacccttttgtaataaaatctacctgatgtcgtcttgttatgccatataattttacggtcccaagtcgtttgtgattaataataagcgattgtagaagtgtgacttgtttaaaagttttcgaaccaagatgaagtatatatgttcattttggtgattgttaataaaatacaac

SEQ ID NO: 608 - DNA, 1663 bp, Canola
cacttaccaatgggtcgtcaagcccaaaaccgtcaaatacgatttcaaaacagacactcgtgtccccaagctaggggtcatgctcgttggatggggaggaaacaacggatcaaccttaaccgccggtgtgatcgccaacaaagaagggatctcttgggcgactaaagacaaagtgcaacaagcaaactactttggctccctcactcaagcttcttcgatccgggtcggatcttacaacggtgaagagatctacgctcctttcaagagtctcctccccatggtgaaccctgacgatgttgtgtttggtggttgggacataagcgacatgaacttagcagacgccatggctagagccagagttctcgacattgatctccagaaacagctcaggccttacatggagcacatggtcccactccctgggatatacgaccctgacttcatcgctgcgaatcaagggtcacgtgctaatagcgtgatcaaaggtactaagaaagaacaagtcgaccagatcatcaaggacatgagggagtttaaggagaagaacaaggtggataagctagttgtcttgtggacagccaacacagagcgttacagcgatgtggtcgtggggcttaacgacacgatggagaatctattggcttctgttgagaagaacgagtctgagatctcgccttctacgctttatgctatagcttgtgttctcgaaggcattcctttcattaatgggagtccgcagaacacgtttgttcctggactcatcgagctggctataacgaagaactgtttgatcggtggggatgatttcaagagtggtcagactaagatgaagtctgttttggttgatttccttgtcggagctggtattaagcctacttcgattgtgagctataatcatttgggaaacaatgatggcatgaacctctcggccccgcagactttcagatccaaggagatctcaaagagcaatgtggtggacgacatggtggctagtaacggcatcctctttgagcctggtgaacatcctgaccatgttgttgtcatcaagtatgttccttatgttggggatagtaagagagccatggatgagtacacctcggagatattcatgggagggaagaatacgattgttatgcataacacttgtgaggattctctattggctgctccaatcatcttggatcttgttcttctcgctgagctcagcaccagaatccaattcaaagctgaaggagaggggaagtttcactctttccacccagtagctaccatactcagttacctcacaaaggcacctcttgtaccacccgggacacctgtggtgaacgctttatccaagcagagggctatgctggagaacatcctcagggcctgcgttgggcttgcgccagagaacaacatgatcttggagtacaagtgaaggacaatgaagaagaagcagagggacctaagactttagaacatgaagagttattatgctcattgtttgtttataaaataattgaattgtgtaagagagacatatcaagaaacttaagtttaattggagtgataatatgatctgagcagtttaattagtgagaagattaagctaagcttttggatcaaatgtgtaatagatttagagtaactatgtgtgtcccgcttgtgttatatcatttaa

SEQ ID NO: 609 - DNA, 1973 bp, Gnetum
aagcggcaggttccttttcagcttagctgttcgctcccttttggcactctttcgtgtcggtttctgcaactcacagcttggcttgctcccgttccgcttccggtgcgtggcttcggcatcttaaattattgttcttgaggcattttgtgttgggagttttctttccgagcgaagatgttcatcgagaacttccgcgttgagagccccaacgtgacctacaccgaggagagcatcgaatcggtgtacggctaccagacgacggagcttgtgcatgagaaccgcaatggcatgtaccagtggatcgtgaggcccaaggaagtcaagtatgagttcaagaccgaccgcaaagtgcctaagctaggggttatgctggtagggtggggtggaaataacggctccacgctcactgccggggtaatcgctaacagagaaggaatctcctgggtgaccaaggacaaggtacagccggcgaactacttcggctctcttacgcaggcctcgacgtgcaggatcggctcttacaatggagaggagatctacgctccattcaagagccttctgcctttggtggatcccaacgatatagtgtttggcggatgggacatcagcaacatgaacttggcggatgcgatggctcgggccaaggttctggaaatggacctacaaaagcagctgcgtccctacatgcagggaataacccctctgccgggcatctacgatccggacttcatcgcagcgaaccagggcgagagggccaacaacatcgtgaagggctccaggaaggagcagatgctgaagatcattcaggatatcagagaattcaaggcgaacacgaaggttgacaaggttgtggtcctgtggaccgctaacactgaacgatacagcaatgtagtggtgggtttgaatgacacgaaggagaatctgttggcagaaacgaattggaaatttctccgtccacaatctacgccatagcttgcgtcctggagggcgtccctttcatcaatggcagtcctcagaacactttcgtccctgggttgattgactttgctgtcgagaagaacagcctcatcggcggagatgatttcaagagtggccaaaccaagctcaagtccgtgctcgtggatttcctcgtgggagctggtcttaagccgacctccattgtgagctacaaccacctgggaaacaacgacggcatgaatctctcggcgccacagaccttccgttccaaagagatctccaagagcaatgtggtggacgacatggtctccagcaacgccatcctctacgagcaaggcgagcatcccgatcacgttgtggtcatcaagtatgtgccttacgttggggacagcaaacgagccatggatgagtacacctccgaaattttcatgggaggcaagaacacgctggttatccacaacacctgcgaagattccctgcttgctgcgcccttaatcctcgatctggtgctcctcgctgagctctgcactaggattcaactcaagaaagaaggcgaggccaagttccattcattccacccggtggcaagtcttctgagctaccttacaaaggctccactggttcctcctggcacaccagtgttaaacgctctggcaaagcagagggccatgctggagaacgtgatgagggcttgcgtgggactggctccggagaacaacatgaccctcgaatacaagtgaagtcttatgcaattgtggaagggacccggtttctgtttcttttcagcacactgttagaaatcatttgcaatttggaaactggtctactgctgtctccttcccgtcttctctcttgtcttctctctgtagccgtatatacagacatcttcatctggtaacctgaatttagattctgtggcttacgcctgtcgcacaccgacaattatgtaaggcacggcgcacattgattgatgtattaagggtacaatgtatgttatgtcgtctacgtaattgatg

SEQ ID NO: 610 - DNA, 2427 bp, Pseudotsuga
ctgtgaggaggagagtgaaccagtgttttcgaagttggcacggctgtgtgattttcgtcagtcagagtcgcccttccaacaactgcgatttctaattcagccacacgaagtattcattcctgaaataacgaaatcgatcctcgcttcagattaccctcaagctttgctgatttgcctcgtttctctgtgctctgaagatgtttatacaaagcttccgcgttgaaagccccaatgtcaagtactctgaggaaagcatcgactcgacctatgactaccagacgactgagctcgtgcacgagaatgctaatggcaaatacgagtgggttatcaagccgaagagcgtgcgatacgagttcaaaaccgagaggcgggtccctaagcttggggtcatgcttgtcggatggggaggaaacaacggctccacgctcacggccggtgtgattgcaaacagagaaggaatctcgtgggtaacgaaggagaaggtacagcaggcgaattactttggctcccttacgcaggcttcgacctgcagaatcggatcctacaaaggcgaagagattcatgctcctttcaagagccttcttcccctggcggagcctaatgacattgtttttggcggatgggacataaacaacatgaatttggcagatgccatggcccgggctaaggttcttgatatcgacctccagaagcagctgcggccttacatgcaaggcatgtttcctcttcccggtatctatgacccggatttcatagcggcaaaccaaggggagagggcaaataatgttctcaagggttccaagaaggagcaactggaaaagattgtccaagatatcagagatttcaaatcgaaaacaaaggtcgacaaggtagtagtactgtggactgctaataccgagcgttacagcgacgttattgtgggtttgaacgatacaaaggaaaccctgcttgcttctctggaaagaaacgagtccgagatctcgccgtccactctctacggcttggcctgcgttctagagaacgttcccttcataaacggcagtcctcaaaacaccttcgttccaggcttgattgatttagcaattacaaagaacagtatcatagcaggagacgacttcaagagcgggcagacaaaaatgaagtcggtgctcgtggatttcttagtcggtgcgggtctcaagccaacttcaattgtgagctacaatcacctcggtaacaacgacgggatgaatctgtcggctccgcagactttccgatcaaaggagatttcaaagagcaatgttgtggatgacatggttgccagcaacgccatcctttacgaaccaggggaacacccagaccatgtcatcgtcatcaagtatgtgccatacgttggagacagcaagagagccatggacgagtacacgtccgagatcttcatgggagggaagaacaccctggtaatccacaatacatgtgaagattcattgcttgcagctcctctgatcctagacttggtgttgcttgccgaactctgcaccaggattcagcttaagaaggaaggcgaggcgaaattccattctttccacccggtagcaagcattttgagctacctcaccaaagctccgctggtaccacctggcacgcccgtccttaacgccctggcaaagcagagggcaatgctggagaacatcatgagggcatgcgtcggtctggctcctgagaacaacatgaccctcgagtacaagtgaagcgctggcgctgagtcggcatcccgagtggcatgggttcattcgttgagcttatgaaaaataaaaacacgttggtccactcaaactagcatctgcagtggttctggtaccttctcgtggaaagatgtctacgtgatgttgtcttgttatgtagaaaatactgtaacagtcgaagtcgtttgtgattaataataagggattgtagaagtgagatctgttcaaagtcttttcgaaccaagatgaagagcagtatgtgctcattttggtgattatctgtagaaaacaacttttcaatctgagttctctttgtattattgtattacctttttcaacttattttataagctatctagcgtgatttcttctgtgtttttttaaaaggctgctggtccctgttatcacacagttcacatgccataaagagttgaaggtaaggattttatattcttatattctttcttttctgcgtgtctgttgttggtgggttgggaggggaagattttttatatgtttaggaggtgcagaaatgtggatttggttattgaaataaatacgtgttatcttgcagcaaatggcttgcatgatgcatttcatcggaaatgaaggttatctaaaattagtttaaaaaataatcactgatcatccataggaaaccaaatataggatacgaaaacatacaggccaaatttgacatttc

SEQ ID NO: 611 - DNA, 2403 bp, Rice
catccaaacacccatccgccgccgctggctgaactcgcgggtgatctgatcggagccggaggaggaggaggaggatgttcgtggagggcttcagggtggagagcccgcgcgtgcggtacggcgacggggagatcgagtcggagtaccgatatgacacgacggaggtggtggcgccgccgtcgccggagaaggggtgggtcgtccgccccaagtccgtcacctaccacttcaagaccaccaccaccgtccccaagctcggggtgatgctggttggatggggaggcaacaacggcaccacgctcacggctggtgtcatcgccaacagagagggaatttcatgggcgaccaaggagaaggtgcacaaggccaactactttggttccctgacacaatcatccaccatcagggttgggagctacaacggggaggagatctatgcgccttttaagagccttgtacccatggtaaacccaaacgacatcgtgttcggtgggtgggacatcagcagcatgaacctggccgacgccatgaccagggctcgggtgctggacatcgacctgcagaagcagctccggcatcacatggagtccatggtgcccctccccggcgtctacaaccctgacttcatcgccgccaaccagggctcccgcgccaacaatgtcatcaagggcaccaagaaggagcaggtcgaacaggtcaagaaggacatcagggagttcaaggagaagagcaaggtggacaaggtggtggtgctgtggacggccaacacggagcggtacagcaacgtggtggccgggatgaacgacaccatggacaacctgctggcgtcgctggacaaggacgagccggagatgtcgccgtcgacgctctacgccatcgcctgcgtcatggagggcgtccccttcatcaacggcagcccccagaacaccttcgtgcccgggctgatcgagctcgccatcaagaagaactcggtgatcggcggcgacgacttcaagagtgggcagaccaagatgaagtccgtcctcgtcgacttcctcgtcggcgccggcatcaagccgacgtcgatcgcgagctacaaccacctaggcaacaacgacggcatgaacctgtcggcgccgcagacgttccggtccaaggagatctccaagagcggcgtcgtcgacgacatggtctccagcaacgccatcctctacgagcccggcgagcaccccgaccacgtcatcgtcatcaagtatattccatacgttggggacagcaagagggccatggacgagtacacctcggagatcttcatgggagggaagaacaccatcgtgctgcacaacacctgcgaggactcgctcctcgccgcgcccatcatcctcgacctcgtcctcctcgccgagctcagcaccaggatccagctcaaagctgaagaccaggataagtaccattctttccatccagtggctaccatcctgagctacctcagcaaggctcctcttgttcccccaggcacaccagtggtgaatgcactggccaagcagagggccatgctggagaacatcctgagggcctgtgttggactggcccctgagaacaacatgatgcttgagtacaagtgatataggccttgacaggtcctcttatcaggagggatgatgaacagcaagtggtggaggaaggtgacagttttcttcaacaagaaaaagaacaaaaaaagagagaaaatgaggaacacctgaaagaaataacaagaggccaagtggggaagcaaatgaaatgatcaagtgatattcattcagaaaatgggtgtcattcacttggatcctcttaattgggggcatctattgacagtttgacactctgctccatgattttttttttcattttttgtttttttaattgagatggagacttttttcagctctgctgctagtatgctgtgagctgcatgaacattggttaatattgtgtatgatgataggtgaagcaaggaactaatcgtcttctatgcttatggatctatagtacaagttgtcagtattactgttaagtcttatatctggaacacttttgaatcaaagaacagctttggtcctagtctgtatttatgaggccatgttctgcttatcaaaatgcagcaatttcctgttattatcctgtaattatgcagatagtgaaaaaaagcaaccttcttcaacatctgcatatgctgtgcaaattctgtactaatggctaaaacatcttggcatccatgggtaaacatcaggttaatgtgaaatgaggtgtgatggttacagttgccagtgccaggaggtgtcttgcggcaatttccagttcatgtcacataatcaatgtatgttcctttcctatgcacggttgtctctcacacacacggcagatttcttccaccggtttaca

SEQ ID NO: 612 - DNA, 1948 bp, Foxtail millet
cggcgggcgagcgagtgggagatctcgagagagggagaggagaaaggatgttcgtggagggcttccgggtggagagcccgcgggtgcggtacggcgccggcgagatcgagtcggagtaccgctacgacaccaccgaggtcgtcccgccgggggatggcggcgctggatgggttgtgcggcccaagtccgtgacctacaacttcaagaccagcaccagcgtcccaaagctcggagtgatgctcgttggatggggcggcaacaatgggacgacgctcacggccggagtcatcgccaacagggagggaatttcgtgggagaccaaagagaaggttcacaaggccaactacttcggctccctgacgcaggcttccaccatcagagtcggcagccacaacggggaggaggtctacgcgcctttcaagagcctcgtgcccatggttgaccccaactctatcgttttcggtggttgggacatcagcaacttgagcatggccgacgccatggccagggccaaggtgctggacatcaaccttcagaagcagctcaggccctacatgcagtccatggtgcccctccccggaatattcaaccctgactttgtcgctgcaaaccaaggtgcccgtgctaacaatctcatccagggcaccaagaaagagcaggtggagcagatcaagaaggacatcagggagttcaaggaaaaaaacaaggttgacaaggttgtcgtgctgtggacggcaaacaccgagaggtatagcaatgtagtcacaggccttaacgacaccatggacaacctcatggcttccttggagaagaatgaggcagagatctcaccatcgacgctgtatgcaatagcctgcgtctctgagggtgtacccttcgtcaatggaagccctcagaacactttcgtacccgggctaattgagcttgccatcaagaagaactcattgatcggtggtgatgacttcaagagcgggcagaccaagatgaagtctgtattggtcgatttcctcgtcggtgctggcattaagcccacctcaattgccagctacaaccacctaggaaacaatgatggcatgaacctctctgctccacaagtcttccggtccaaggagatctccaagagcagcgtggtcgacgacatggtcgccagcaatcccatcctatacagtcccggggaacaccctgatcacgtcatagtgatcaagtacatcccctatgtgggagacagcaagagggctatggacgaatacacctctgagatcttcatgggcggaaagaacaccatcgtgctgcacaacacctgtgaggattcgctcctcgcagcacccatcatccttgacctggtgctcctggctgagctcagcacacggattcagctcaaagccgaagggcaggacaagttccattccttccatcctgtggctaccattttgagctatctcagcaaggctcctcttgtacccccaggcacaccagtggtgaatgcactggccaagcagagagccatgctggagaacatcctgcgggcctgcgtaggcctcgcccccgagaacaacatgatccttgagcacaaataaagagttccacattcacggatgacgacaagaagagatagaagggaaggcatggatcaagcgaaggtgtgggaataagtcgcctcctccaaacctgaagaagaaataacaggaggccataggaaggaaaagggccatggaggaagatcaaacatggatgatatcagatggatcctctttgaaggctttcttttcctttttcagatttggctcattttcggtactcatgagactagattgtgtattggatctctgctgtgcgcggcatgaagcctttatttacttggtgtgtgataagagctgttagaaatgtccagtctaattttcagaaaatcaaaactcttagttgctttatatgctgattgctggatgat

SEQ ID NO: 613 - DNA, 2225 bp, Maize
gttgaagaatcagatagctgtctcaaatagctgaaatgtgtaaaaaaatgcggatacagatctggattataactacacaaattaaggagtatcctcgcaaaagaaaaaaaagaaatgaggagaagagacaaccgatcggattccgaatttccgatccgagagaatcggccaggccactcgcaccgcgaccactcgtcattagtcgcgctcctcccgcggcgaaccccacgtggaggccgcgcgcagctatataatggactatccttggatccccgcatatcgttgagcgagttccgagggtgaggcggcgattgctgcgttccgtccgttcgtttttgtgtggggcagaagccaactaagaccgcgaggagatcggaggatgttcgcggagagcttccgggtggagagcccgcgggtgcggtacggcgacggcgagattcagtcggagtaccgctacgacactaccgaggtcgtcccgccggggaatagcggcgcagggtgggtggtgcgcccaaagtccgtcacctacaacttcaagaccagcaccaacgtcccaaagctcggggtgatgctcgtcggatggggcggcaacaacgggacgacgctcacggccggggtgatcgccaacagggaagggatttcgtgggagacgaaagagaaggttcacaaggccaactacttcggctccctgacccaggcttccaccatcagggtcggctcccacaacggggaggagatctacgcgcctttcaagagcctcgtgcctatggttaaccccaacactatcgtctttggtgggtgggacatcagtaacctgaacatggccgacgccatggccagggcccaggtcctagacattcaccttcagaagcagctcaggccctacatggaatccatgcagccactcgccggcattttcaacccagacttcgtcgccgcaaaccaaggtgcccgtgctaacaatatcattaagggaaccaagaaagagcaggtggagcagatcaggaaggacatcagggagttcaaggaaaagaccaaggtcgacaaggtagtcgtgctatggacagcaaacaccgagaggtatagcaacgtggttgcagggcttaacgacaccatggacaacctcttggcatcgctggacaagaatgaagcagagatctcaccatccaccttgtacgcaatagcctgtgtctttgagggtgttccattcgtcaatggcagccctcagaacaccttcgtgcctgggctgatggagcttgccataaaaaagaattcggtgataggaggcgacgactttaagagtgggcagaccaagatgaagtctgtgttggtcgatttcctcgtcggtgctggaattaagcccacctcaattgctagctacaaccacctaggaaacaatgatggcatgaatctctctgcgccacaagtcttccggtctaaagagatctccaagagcagcgtggtggacgacatggtcgctagcaatccgatcctctacaagcccgatgaacatcctgatcacgtaatcgtgatcaagtacatcccctatgtgggtgacagcaagagagccatggacgaatatacctccgagatcttcatgggcggcaagaacaccatcgtgctgcacaacacctgtgaggactcgcttctcgcctcgccgatcatccttgacttggtgctcctagctgagctcagcactcggattcagctcaaggctgaagggcaggataagttccactccttccatcctgtcgccactattttgagctatcttagcaaggctcctcttgtaccccctggcacacccgtggtgaatgctctagccaagcagagggccatgctggaaaatatcttgcgggcctgcatcggccttgcccctgagaacaacatgatgcttgagcacaagtgaaagagtttcatatccctaatgaccacagaataggatgaatggaatggtgggatcgagcgagcccaatgaagaaataacaggaggccagaaaaagtgtacggagagaagatcaagtatggatgatgccacatagacccttttttaacgttatcattttttttagatttgactcgttttggggtgattagattgtgtactggctatccattgtatgcagcatgaaacctttatttatttgttgtgtgatagaggttatagaagtatctaacctaatttcttaaactcttagttgattaatatttttaattgatcgctg

SEQ ID NO: 614 - DNA, 2033 bp, Zamia
acaaattggatctgacccacatattttttttggcatattgggtagtaaggtgaggtgggcttccaggcgcctattgcctctgctttggatttctggcattgcttctctgttgggttgggtctgttgggttgtgggcgattccttagaaaatgttcgtcgagagtttccgcgtggagagccccaatgtgaaatactcggaagaaagcatagagtcggtgtataactatgaaaccacggaagtcgtgcaccagtgcaagaacggcaagtacgagtggatcgtcaagcccaccactgtgaagtaccagttcaacactgatcgccgggttcccaccttaggggtcatgcttgtgggttggggcgggaacaacggtaccactctgactgcgggagtaattgcaaatagagaagggatctcatggctgactaaagagggagtgcaacaggcgaactatttcggttccctcacacaagcatctacttgcaggattgggtccttcaatggggaagagatttacgcccccttcaggagcctgcttccgatggttgatcccaatgatattgtgtttggaggatgggatataaacgacatgaatttggcggatgccatggcccgggccaaggttctggacgttgatctgcagaagcagctgcggccttatatggaaggcatggttccgctccctggaatctacgatccggatttcatagctgcaaaccaggactctcgggcaaacaacattattggggggaccaaraaggagcaggtgcaraaaatagtccaagacataaragaattcaaggccaaaacaaaggtggagaaagtggttgtactctggacggccaacactgaacggtatagcaacgtttcagtggggctgaatgatacagaggaaaatttgcttgcatctcttgagaggaatgagtcaragatctcaccatcgaccttatacgccttggcttgtgttcaggagaatgttcctttcatcaatgggagccctcaaaacacctttgttccaggcctaatcgacttggctatttcraagaacagtcttattgcaggggatgacttcaaaagtggacagacaaagatgaagtcggtgcttgtagatttccttgttggggccggtatcaagccaactgccatagcaagttacaatcatctaggaaacaacgatgggttgaatctgtctgctccccagactttccggtccaaggaaatttcaaagaccaatgttgtagatgacatggtttccagcaatggtattttgtatggacctggtgaacatcctgaccatgttattgtcatcaagtacatcccttatgttggagacagcaagagagctatggatgagtatacatctgagatttttatgggagggaggagcactattgtactgcacaatacctgcgaagactctttgcttgcagctcccataatcttggacttgatattacttgctgaactttgcagcaggatcaagctgaagaaagagggggaggggaagttccactctttccatccagtggcaagtattttgagctatctaacaaaggctccactcgttccgcctggcacgcctgtgattaatgctctagcaaagcagagggcaatgctggagaacatccttagggcatgcattggcttggctcctgagaacaacatgctccttgaatacaagtagagccacatctctcacagcacagcagtggcatagttctgtatagtttagagggattactattttggttaccacaaacattttcttgtttcattaagcgtgctttattayctatagagtctctggagataacttcaagagcagatgtgttttatatataatatgtggcttcaagttttctacttttgtgtttacatttgatatcaggaaagcagtgttttataggtttgcaaagtcagaaaattgtgcaacacagacatgttgtacatactggctctttgtgacgtttggtggaaataccacatgttggtgattgttgtgtgrcaatacaatacatgttgctacaaaaaaaaa

SEQ ID NO: 615 - DNA, 1860 bp, Potato
gtgtttgtgagtgaaaatgtttattgagaactttaaggttgagagccccaatgttaagtacacagagagtgagattcactctgtgtatgattatcaaacaactgagttagttcatgaggaaaaaaatgggacatttcaatggactgttaagccaaaaactgttaaatatgaattcaagactgatgttcatgttccaaattaggggttatgcttgttggatggggtggaaacaatggttcagccttgactggaggtgttattgctaacagagaaggaatttcatgggctaccaaggataaagtgcagcaagccaattactttggctctcttacacaggcctctactattcgagttggttccttcaatggagaggagatctatgccccctttaagagcatacttcccatggtcaatccagatgatgtagtgtttggaggatgggacatcagcaacatgaatttggcagatgccatggcaagggctaaagtttttgacattgatcttcaaaagcagctgaggccctacatggaatccatggtcccactgcctggtatctatgaccctgatttcattgctgcaaaccaaggctcacgtgctaacaatgtcattaaaggaaccaagaaagaacaaattgatcaaatcattaaggatattagggagtttaaggagaacaacaaagtggacaaggtggtggttttgtggactgctaacactgaaagatacagcagtgtggctgttggccttaatgataccatggaaaacctctttgcttctgtggatagaaatgaggctgaaatatctccttccaccttgtatgctattgcttgtattcttgaaaatgtgcccttcatcaatggaagcccacaaaacacttttgtcccaggcctcattgatttggccatcaagaggaacactttgattggtggtgatgactttaagagtggtcaaaccaagatgaagtcagtgctggttgatttccttgttggagctggtattaagccaacatcaattgtgagctacaaccatttgggtaacaatgatggaatgaatctgtcggcccctcagactttccgctcaaaggagatctcgaaaagcaatgttgtcgatgacatggtttctagtaatgccatcctttatgagcctggagagcaccctgaccatgttgttgtgattaagtatgtaccatatgtgggagatagcaagagggcaatggatgagtacacatcagagattttcatgggtggaaggaacaccattgtattgcacaatacctgtgaggattctcttttggctgctccaattatcttggatttggtcctcttggctgaactcagcacccgcattcagctcaaagctgaaggagagggtaagttccactccttccatcccgtggcgaccatcctcagctatcttaccaaggctcctctggtaccaccaggtacaccagtggtgaatgccctttcaaagcagagggcaatgcttgagaacatattgagggcttgtgttggactggcaccagagaacaacatgatattggaatacaaatgaagatctcataagaagtgaaaggactcaagaagccgtgtagcagaagaaccatgttgcctttctttacttttatttttgtaatcttttgtctcatcattagtactataattagctaaatctcagccaacccttggaggtatagctgttgtttaatggcgggctaagttgagtgtcattatgatttctttgtgtattagcccttcattttgaagatgtattatcagtgttgtcttagctctttagagccagcaacgccttttctctaccggaaatacaacgtatagtcttactctaaaaaaaaaaaaaaaaaaa

SEQ ID NO: 616 - DNA, 2015 bp, Millet
aagctcaccgaccacgtcgaggaccggcagctcgacacctccctcgtcctacatcaccaatccgtcgtgcctttgagcgagtcttcgtcttgttcttgcattgggaggtgagagtgtgccttgagcgcgcgcgaggatgttcgtggagggattccgcgtggacagcccgcgggtgcggtacggcgccggcgagatcgagtcggagtaccgctacgacaccaccgaggtcgtcccgccggccgatggcggcgccggatgggttgtgcggcccatgtccgtgacctacaacttcaagaccagcaccaccgtcccaaagctcggggtgatgctcgttggatggggcggcaacaacgggacgacgctcacggccggagtcatcgccaacagggagggaatttcttgggagaccaaggagaaggttcacaaggccaactacttcggctccctgacgcaggcttccaccatcagagtcggcagccacaacggggaggaggtctacgcgcctttcaagagcctcgtgcccatggttgaccccaactccattgtgtttggtggttgggacatcagcaacttgagcatggccgatgccatggccagggccaaggtgctcgacatcaaccttcagaagcagctcaagccctacatgcagtccatggtgcccctacctggcgtcttcaacccagactttgtcgctgcaaaccaaggtgcccgtgctaacaacctcatccaaggcaccaagaaagagcaggtggagcagatcaagaaggacatcagggagttcaaggaaaaaaacaaggtcgacaaggttgtcgtgctatggacggcaaacactgagaggtatagcaatgtagtcgctggccttaatgacacaatggacaacctcatggcttccttggagaagaatgaggcagagatctcaccatcgacattgtatgcaatagcgtgcgtctctgagggtgtacccttcgtcaatggaagccctcagaacactttcgtacccgggttgattgagcttgccatcaagaagaactcgttgatcggtggtgatgacttcaagagcgggcagaccaagatgaagtcggtattggttgattttcttgtcggtgctggcattaagcccacctcaattgccagctacaaccacctaggaaacaatgatggcatgaacctctctgctccacaagtctttcggtccaaggagatctccaagagtagcgtggtggatgacatggtcgccagcaatcccatcctatatagtcccggggaacacccagatcatgtcatagtgatcaagtacatcccctatgtgggagacagtaagagggctatggatgaatatacctctgagatctttatgggtggaaagaataccatcgtgctgcacaatacctgtgaggattctctcctcgcggcacccatcatccttgacctggtgctcctagctgagctcagcacacgaattcagctcaaagctgaaggacaggataagtttcattccttccatcctgtggctaccattttgagctatctcagcaaggctcctcttgtacccccaggcacaccagtggtgaatgcactggccaagcagagagccatgttggaaaacatcctacgggcctgtgtaggtctcgctcccgagaacaacatgatccttgagcacaaatgaagagttgcacattcagggacgacagaagaggagatacaaggggggcatggatcaagcgaaggtgcgcgaataagtcgcctccttcaaaatgatgaaataacaaccgaccataggaaggagaagggccatcgatgatatcacatgtattctttttaaaggctttatttttcttttgcagatttagctttggtactcatgggactagattgtgtattggctttgctttgctatgtgtggcatgagcttttatttacttggtgtgtgattagatctgttagaaatgttcagtctagttttagaaaatcaaaactcttagtttcttttacgagactgatgattgctggatgat

SEQ ID NO: 617 - DNA, 1490 bp, Cleome gynandra
caccctcaagaatcaaaaccaaacggagaagaagcaaaaacagctctggttctagagatagagagagaaaatgttcatcgagagcttcaaggttgagagcccaaacgtgaaatacacggagaatgagattcattccgtgtataattatgaaacgacggaggttgttcatgagaacattaacggtgtttaccagtggattgtaaagccaaagactgtgaaatacgaattcaaaaccgatgttcatgtcccaaaattaggggttatgcttgtgggctggggaggaaacaatggctccactcttacagccggtgtaattgcaaacaaagaaggaatatcatgggcgacaaaagataaagtgcagcaagcgaattacttcggttctcttacacaagcatcatccattcgtgtcggatcattcaacggagaagagatctacgctccattcaagagccttcttcctatggtgaaccctgacgatgttgtgttcggtggatgggatataaacgacatgaacttggcagacgccatggaagggccaaggttcttgacattgatttgcagaagcaactcagaccttacatggagaacatggtcccactcccagggatctacgatcctgatttcatcgcagcgaatcaagattcacgtgccaataacgtcatcaaaggctccaagaaggaacaagttgatcagatcattaaagacataagggagttcaaggagaagaacaaggtagagaaagtggtggttctatggacagcaaacacagaacgttacagcaatgtgatcgtagggttaaacgatacaatggagaatctattgtcatctgtggacaagaatgagttagagatttcaccttcgacactttacgcaattgcttgtgtttttgaaggcattccgttcatcaatggaagccctcaaaacacatttgtaccaggtctggtggatatggccatcaggaggaactgtttgattggtggggatgacttcaagagtggtcagactaagatgaaatctgtcttggtcgacttcctcgttggtgctggtatcaagcctacatcgattgtgagctacaaccatttagggaataacgatgggatgaatctctcggcccctcaaacgttccgttccaaagagatctcgaagagcaacgtggtggacgatatggttgctagtaatggcatcctttatgaacctggtgaacaccctgatcacgttgtcgtcatcaagtatgtaccgtacgtagcagatagcaagagggcgatggacgaatacacatcggaaatattcatgggagggaaaaacacaattgtgatgcacaacacttgcgaagattctctcttggctgctcccattatattggatcttgttcttcttgctgaacttagtacgaggatccaactcaaagccgaacaagaggcaaagttccattctttccacccggtcgccaccatcctcagttacctcaccaaggcacacaggggataggg

SEQ ID NO: 618 - DNA, 1624 bp, Clover
ttgggggtaatgcttgtgggatggggtggaaacaacggttcaaccctgactggtggtgttattgctaatcgagagggaatttcatgggcaaccaaagataatattcaacaagctaattactttggatccctaactcaagcttcagctatccgtgttggatctttccaaggagaggaaattcatgctcccttcaagagcttgcttccaatggtcaaccctgatgacattgtttttggcggatgggatatcagtaacatgaaccttgctgatgccatggccagggccagggttttcgacatcgatttgcaaaagcaattgaggccttatatggaatccatggttccacttcccggtatttatgacccggatttcattgctgccaatcaaggagaacgtgctaataatgttatcaagggtacaaagagagaacaaattaaccaaatcatcaaagacattagggaatttaaggaagctaacaaagtggacagggttgttgtcctctggactgctaacacagagaggtacagtaatttggttgttggactcaatgacaccacagagaacctttttgctgctgtggacagaaatgagtctgagatttctccttccaccttgtttggtattgcttgtgttttggaaaatgttcctttcattaatggaagccctcagaacacctttgtcccagggctgattgatcttgccatcaagaacaacagtttgattggtggtgatgacttcaagagtggtcaaaccaaaatgaaatctgttttggttgatttccttgtaggagctggtatcaagccaacatcaatagtgagttacaatcatcttggaaacaatgatggtatgaacctctcagcaccacaaactttccgctccaaggaaatttcaaagagtaatgttgttgacgatatggtcaacagcaatgccatcctctatgcgcctggcgagcatccagaccatgttgtagtcattaagtatgtgccktatgttggtgacagcaagagagccatggatgagtacacttcagaaattttcatgggtggaaagaacactatcgtgttgcacaacacgtgtgaagattccctcttggctgctcctattatcttggatttggttcttcttgctgagctcagcactagaattcagttcaaatctgaagctgagaacaagtttcacacattccaccctgtagctaccatcctcagttacctgaccaaggctcctttggttccaccgggcacaccagtggtgaatgcattgtcaaagcagagagcaatgctcgaaaacatcatgagggcttgtgttggattggctccagagaacaacatgatcctcgagtacaagtgaagccggtggatagaatcatagtcggaactccctctagctgaatcagaacttgctcttttcatcccttttattcttcttttgagaatgtttgctgatgttttcataagtgtaatatttggtagtctttgctcccaagtggctttagagcagagcttagcttgtgttttagtacatgaaaatctataaatatttatgtgctttgtgctcaattagtgtttatggctctaccttttcttttaatggtataatataatatagcaacctttaatttaaa

SEQ ID NO: 619 - DNA, 1715 bp, Pteridium
atgttcatcgagagctttcgcatcgagagccccaacgtcgaatacacagaggattacatccagtccagttatgaatactccaccacagagctcttacatgagaagcgtggtggccaataccaatgggttgtgaagcccacctctgtgcactaccaattcaagacctctcgtcgcgtccccaagctcggggtgatgcttgtgggctggggcggaaacaacggggcaacgcttacagcaggcgttattgcaaaccgagaagggatatcttgggtgacaaaggagggtgtgcagcaagccaattacttcggctcgctaacacaagcgtcaacatgccgtgtgggatccttcaatggagaagagatatatgcaccattcaagagcttgttacccatggttgaccccaatgacattgtctttggtgggtgggacatcaatggtgcgaatttggcagatgctatgtcgcgggctaaggtcttggatatggatcttcaaaagcagctccgaccttacatggaagagatcgtacccctccctgggatctatgaccctgacttcattgcgtccaaccagggtgctcgtgccaacaacctcatcaagggcaccaagaaacaacagatggagcaaattgtttcggacatcagagaattcaaggccaaaagcatggtggacaaagtagttgtactatggaccgcaaacacagaacgctatagcgatgtcattgttgggctgaatgacaccaaagaaaatctctttaaatctctcgaaagaggagagcctgagatttctccatctacgctttatgcattggcatgcattcaagaaaaggttcctttcatcaatggaagtccacagaacacctttgtgccaggagtcattgaatacgccgtgtctcaaaacagcctcatcggtggtgatgattttaaaactggccagacaaagattaagtctgttttggtggattttcttgtcggagctggcatcaagccaacctctattgtgagctataatcacttggggaacaatgatggcatgaacctttctgccccacaaacattcagatcgaaggagatttctaagagcaatgttgttgatgatatggtgggtagcaatgccatcttgtacaagccgggagagcatcctgaccatgtcgtggttatcaagtatgtgccctatgtgggggatagcaaaagagccatggatgagtacacatccgaaatttttatggggggaaggaacactattgtcctgcacaatacctgtgaagattcattgctggcagcacctctaattctcgatttggtacttctagctgagttacttacaagaattgagttgaagaaggaaggagaggataagttccattctcttcatccagtggcagctcttttaagctatcttaccaaggcacctcttgtgccgcctgggactcctgttatcaatgccttagcaaagcagagggctatgttggagaacatatttagagcttgcattggacttgcccctgagaacaacatgcttatggagtacaaatagagcatccccaattacattggacatgccctataatttttggcttgcattagaaatttttttgaagaaaagctcatggattaccataatgcgtgtagtttaaccattaacctgctccctataatactgttgaggagtttgatgtactgtgttgtttgattccctaccgaatgtccacattgttt

SEQ ID NO: 620 - DNA, 1691 bp, Oil palm
aaatacacttcaagacagacacccgtatccccaagctcggtgtaatgcttgtggggatggggtgggaacaatggatccaccctcaccgctggtgttattgccaaccgagaagggatctcctggggcaaccaaggacaaggtgcagcgagccaattatttcgggtcactgacccaggcctccaccattcgggttggatccttcaatggggaggagatctatgccccattcaagagcttgcttcccatggtgaatccagatgatatagtgtttgggggatgggacataagcaacatgaacctggctgatgccatggccagggccaaggtcctggacatagacctccagaagcagttaaggccctacatggagtccatggtcccactcgctgggatctatgatcctgatttcattgctgcaaaccagggttcaagggccaacaatgtgatcaagggtaccaaaaaggagcaagtccaacaaatcatcaaagacattagggaattcaaggagaagatgaaggtggataaggtggtggtcctgtggaccgcaaacactgagaggtacagcaatgtgttggtgggggtgaatgatacgatggacaacctcttggcttcattggagaagaaccaggctgagatatctccgtcgaccttgtatgcgattgcttgtgtccttgaaaatgtcccattcatcaatggaagcccacagaataccttcgtgccgagtttgattgatttggctatccagaagaacagtctcattgggggagatgactttaagagtgggcagactaagatgaaatctgtcctggtagattttcttgtaggggctggaattaagccaacctccatagttagctacaaccatctggggaacaacgatggcatgaatctatcagcaccacaaaccttcagatcaaaggagatatccaagagcagtgtggttgatgacatggtttcaagcaatggcattctgtatgagcccggggagcatcctgaccacgttatcgtcatcaagtatgtgccctacgttggggacagcaagagggcgatggatgagtacacctcggagatcttcatgggtgggaggagcacaattgtactgcataacacttgtgaggattcactgttggcagcacctatcatacttgacctggtcttgctagctgagctcagcaccaggattcagctcaaagctgaggaagagggaaagtttcattccttccacccggtggctaccatcttgagctaccttactaaagctccattggtccctccaggcacaccagtggtcaatgccctctcaaagcagagggccatgctggagaacatcctcagagcttgcattgggctggcccctgagaacaacatgatgttggagcacaagtgaagcatctaaagagaaaagaaaggaggttaaatatgagtgcattgacttgttcttatgcctctggatgtcagagattgcttccttgtactattcagattcacctctttcaagaggagtaattttatagtattaattgttttgcacatgactcttctctgtgatttgtaatcttaattaacgaagctggaacaatgccatatatttatatattggttggcccggagaaccccatatcattagttttgtaggctttacacccttttgtcttcctagtgaatgttataatgtgccaccttttattaat

SEQ ID NO: 621 - DNA, 2056 bp, Zostera
agcccaacttcgaacgcaaaccaatggcaatggaaatggtggctacttccgccgtctctctccgtgctcatcgtagtaactcttttttatccaatgatattaagaccactcgtggtctattcccaccgtccaatctcaccagaagaagactcgtcatgacacttgatgttaagcaaggcgataatatggtggagctcaaatcaaaccaaagtgggacccaaatacctattgatcagaaagccccaacctttgttgagaacttccgtgtcgacagcccagacgttaagtatggggagaatgagatcgagacggagtacaagtatgatacaactgagcttgtatacgagaatcgaaacggctccaactccaagcagtggtatgtcaagcctaagtccgtcgtctacaatttcaagaccagcactcgcgttcccaagcttggggtgatgctcgtgggatggggtgggaacaatggatccactctcactgccggagttattgccaacagagagtcaatgtcatggcccaccaaagagaaaatgttgcatgccaactattttggatcactcacgcaggcttctactgtaagggttggttcgtacaatggggaggagatatatgctccctttaaaagtttactgcccatggttgatccaaatgacgtcgtttttggaggatgggatattaatggcatgaatctagctgatgccatggacagggctaaggttcttgattatgaacttcagaggcaattaaagcctataatggagtccatggtaccacttcctggaatttatgatccagacttcattgctgccaatcaaggatctcgtgctgataatgttatcaaaggcacaaaaaaagaacaactcagacaaatcattaatgatattagggactttaaggacaagactaaagtcgataaggttgtagttttgtggactggaaataccgagcgatacagtaagattgttgatggacttaatgatacctctgataatcttctcgcggcactagataggaacgaatctgagatatcaccttcaactatttatgcaatggcctgcatccttgagaagattcctttcattaatgggagcccacaaaatacttttgtccctggtctcattgaattggcaataaaaaataacactatgataggtggagatgatttcaagagtggacagacaaaaatgaaatctgtcttagtggattttctagttggagctggaatcaagccaacatccattgtcagctataaccatcttggaaacaatgatggtatgaatctctcggctcctcagacattccgttccaaggagatatcaaagagtaatgttgttgatgatatggttgctagtaacccgatactttatgagcctggtgaacatccagatcacgttgttgtcatcaagtatgtaccatatgttggagacagcaagagggcgatggatgagtactcatcagagttatttatgggtggaaaaagtaccatcattcttcacaacacctgtgaggactcgttactggctgcgccaattatattagatcttgtattattagctgagatgagcactaggatccagctaaaagccgagggagaggaaaacttccactccttccatccaattgcaacaattttgagttatctgagcaaggcaccacttgttccacctggcacaccagttgtgaatgctctatcaaagcagagggctatgctggaaaatatcatgcgagcatgcattggtttggctccagaaaacaacatgttgctagaacacaaatgaaccctaaattctctgtagaacataagatggggcgaacataagatgtgcttgattgtgtttatttgtaaatcaaacctaatattgtctatttatgtacctttggtagtactgtgaaattgaaaattgtaacttatgtatgagacgattgtctcatctccttggaggcatgtggctagtgctcggaaggctttgtactttgcgagtccgttgtcggtggcgtggttgagttgtagttgtttccagagatcgaacgtttttgttgcatgtagttg

SEQ ID NO: 622 - DNA, 2232 bp, Rye
gaatctatgtatctcgcgtgcccgtgtccacggaatcgttggtgatcccggcgcctggtactggcaccggcagaggctctccccagcccgccggctctccccggcggccaagctgtctcgccgccgccccggctggcactggcaggccctctcctccgcgctcccgcgcaccttcggcgtggaccccagcgaaaccacgtggccgcgtaacccgctataaatcccccacccccgcccgcccgcccacccaccgcagatcacacacaattcactccagccccccctctctctcactccaacagtctccggaaaagagagagagggagagagatcgatcttgcgttgccaagatgttcatcgagagcttccgcgtggagagcccgaacgtgcggtacggcgcgggggagatcgagtcggagtaccgctacgacaccacggagctggtgcacgagagccacgacggcgcctccaagtgggttgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggcgaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgaccagggccaaggttttagacattgacctgcagaagcagctgaggccctacatggagtccatcactccgctccccggcatctatgacccggacttcatcgctgccaaccagggctcccgggctaacaatgtccttaagggtacaaagaaagagcagatggagcagattatcaaagacatcagggagttcaaggagaagaacaaggtggacaaggtagtggtgctttggacggcaaacactgaaaggtacagcaacgtctctgttgggcttaatgacacgatggagaacctgttggcgtctgtggacaagaacgaggcagagatatccccatcaacactgtatgccatcgcctgtgtcatggagggtgtgccgttcatcaacgggagccctcagaacacctttgtgcctgggctgatcgatcttgctattaagaacaactgcctgattggtggcgatgatttcaagagtggccagaccaagatgaaatctgtcttggttgacttccttgttggagctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccacgtcgtcgtgatcaagtatgtgccatatgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggagaggacaagttccattccttccacccggttgcgaccatcctgagctacctcaccaaggcaccctgtcgtctggcacgcgtgtgacgcctggcgaagcagagggcgatgctggagaacatcatgagggcgtgcgtcggcctggcgcccgagaacaacatgatcctggagtacaagtgaggagcaccgcccaagctcgcggagccgagagagaccgtacgtacgtagcaagtggcgaggggcgacgggagggctggaggaagaagaaggcgagatcggctgtggaattatttggcggcttgtctttagtttcctttgcgattctttccctggttaagtttaccctagtgtgtatgtgtgtgtctccttgcgagactatttcggctctttgcgacatggtagcttctcatggactccatggtgttggatgatgtggagggaggagggtgcgtgctagcttaaagttagtccactccctctgttcgtgttttgtaagttaattagtaatatgtgtactactagtatatggaactttcaa

SEQ ID NO: 623 - DNA, 1479 bp, Rye
ccccctctctctcactccaacagtctccggaaaagagagagagggagagagatcgatcttgcgttgccaagatgttcatcgagagcttccgcgtggagagcccgaacgtacggtacggcgcgggggagatcgagtcggagtaccgctacgacaccacggagctggtgcacgagagccacgacggcgcatccaagtgggtcgtccgccccaagtccgtcaactaccacttcaagaccaacaccaacgtccccaagctcggggtgatgctcgtggggtggggcggcaacaatggctccacactcatggctggggtcatcgccaacagggaggggatctcatgggccaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgaccagggccaaggttttggacattgacctgcagaagcagctgaggccctacatggagtccatcacgccgctccccggcatctatgacccggacttcatcgctgccaaccagggctcaagggctaacaatgtcctcaagggcacaaagaaagagcagatggagcagattatcaaagacattagggaattcaaggagaagaacaaggtggacaaagtagtggtgctttggacggcaaacactgaaaggtacagcaacgtctctgttgggcttaatgacacgatggagaacctcttggcatctgtggacaagaacgaggcagagatatccccatcaacactgtatgccatcgcctgcgtcatggagggtgtgccgttcatcaacgggagccctcagaacacctttgtgcctgggctgatcgatcttgctattaagaacaactgcctgattggtggcgatgatttcaagagtggtcagaccaagatgaaatctgtcttggttgacttccttgttggtgctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccatgtcgtcgtgatcaagtatgtgccatacgttggagacagcaagagggccatggacgagtacacctcagagatcttcatggggggcaagagcacgatcgtgctgcacaacacctgtgaggactcgctcctcgccgcacccatcatccttgacctggtgctcctggccgagctcagcaccaggattcagctgaaagctgagggagaggacaagttccattccttccacccggttgcgaccatcctgagctacctcaccaaggcac

SEQ ID NO: 624 - DNA, 1500 bp, Canola
tgaaatatgagtttaagaccgacactcatgttcccaaacttggagtgatgctcgttggttggggaggaaacaatggttctactcttaccgctggtgttatcgccaatcgcgagggaatatcctgggctacgaaggagaaagtgcaacaagctaattatttcgggtcattaacccaagcatcctctatccgggtaggatcatttaatggggaagaaatctatgctcccttcaaaagtcttctccccatggttaatccggaagaaatagtgtttgggggatgggacataagcgatatgaacttagcagacgctatgggacgagccaaggtcctagacatcgacctccaaaagcagctgcgtccgttcatggaacacatggtccccctccctggaatctacgacccagatttcatcgcagctaaccagggatcccgtgccaaccacttgatcaaaggcaccaagaaagaacagctagaacaagtcatcaaggacatcagggatttcaaagagaaaaacaaagtggacaaggtggtggtgctatggacggccaacacagaaagatacagcaatgtggtggctggtcttaacgacacgacggagaatctcatgtcatctttggacaagaatgaggctgagatttctccttctacactctacgccattgcttgtgttcttgagaacgttcctttcatcaatggaagcccacaaaacacttttgtccccgggcttattgaattagcaatcaagagaaacagcttgatcggtggtgatgacttcaagagtggtcagaccaagatgaaatctgtcctcgtcgatttccttgtcggcgctggaatcaaaccaacctcgatagtgagctacaatcaccttggaaacaacgatggcatgaatttgtcggcgccgcagacattccggtctaaggagatttctaagagcaatgtggtcgacgacatggttgctagcaatggtattttattcgattccggtgaacaccctgaccatgttgtcgtcattaagtatgtgccatatgttggagacagcaagagagccatggacgagtacacgtcagagattttcatgggagggaagaacacaattgtgatgcacaacacttgtgaagactctctcttggctgctcccattattttggaccttgttcttctcgccgagctcaccaccaggatcgagctcaaggccgacaatgagggaaagttccattctttccatccagtggctactcttctgagttacctctccaaggcaccattgggtcccacctggcacgccagttgtgaacgcttgtcgaagcagcgtgcaatgcttgagaacatactcagagcttgtgttggacttgctccagagaacaacatgattctcgagtacaagtgaagaagagatcagtcaggagatccgcttcatttagctttgcttcattttatgttttcatgaataagtacctttttataagggttgacttcttatttaagccttatattatatt

SEQ ID NO: 625 - DNA, 1596 bp, Distylium
ggagattgagtgagcagaagcctgtattttagctttggggaaaatgtttatcgagagcttccgcgtgcagagcccgaatgtgaagtacacagaggagacaatcgagtcggtgtatgactatgcaacgacggagctcgtccacgagaacaggaacggcaagtacgagtgggtcgtcaagcccaagtgcgtcaagtacgagttcaagactgctcggcgggttcccaagcttggggttatgctggtaggatggggtggaaacaacggctccactctcactgcgggtgttattgctaacagagagggaatctcttgggtgactaaggataagatccaacaggccaattactttggttctctcactcaggcgtccacttgcagagtcggatcctacaatggcgaggagattcacgctcctttcaaaagccttcttcccatggtggaacctaacgatgtcgtattcggtggatgggacatcagcaacctgaacttggcggacgccatggcccgagccaaggtactggacatcgatctacagaagcagctcagaccctacatgcaagacatgatgcctcttcccggcatctttgaccccgacttcatagccgcaaatcaaggcgagagggcaaatcatatcatcaaaggttccaagaaggaacaggtcgacaaaattatacaagacatcagggaattccaggcaaacacaaaggtggagaaagttgtagttctctggacggccaacacggaacgatacagcgacgtcattgtgggactcaatgacacgaaggagaatctgctcgcatctctcaacaagaacaagtccgagatctctccctctactctctatgctattgcttgtattcaggagaacgttcccttcatcaacggcagtcctcagaacacttttgtgccgggtctgatagagctggcaatcgaaaagaacagtcttataggaggagatgacttcaagagtgggcaaacaaagatgaagtccgtgcttgtggatttccttgttggtgcgggtatcaagccaacgtccattgtgagctacaatcatctgggaaacaatgacgggatgaatctctcggctccccagacattccgttcaaaggaaatttctaagagcaatgttgtggacgacatggtctccagcaacgccattctctatggacctggtgaacacccggaccacgtcgtcgtcatcaagtacgttccctatgtcggagacagcaagagggccatggacgaatatacatccgagattttcatgggaggacagaacacaattgtaatgcacaatacctgtgaagactctctgctcgcggctcctttgatcttggacttggtcttgctggctgaacttagcaccaggatccagcttaagaaagagggcgaggcaaaattccactctttccaccctgtggcaactattctgagctaccttaccaaagacccctcctggtggccacctcggcacacctcgtagtgaacgccctacgctactcataaggagggaccatagttgcaacctttgtctacttctatgttcaaacttacaagacaacctccacagcaccaggaccgagtagccgtaccacc

SEQ ID NO: 626 - DNA, 1499 bp, Utricularia
ccttcctaaatttggggtgctgttggtcggatggggcgggaataatggttccactctgaccgccggcgtcattgccaatcgcgagggaatttcatgggcgacaaaggataagattcagccggctaattactttgggtcactgactcaggcatcgacaatcagagtcgggtctttcaatggagaagagatttatgctccatttaagagcttggttcccatggtgaaccctgatgagattgtctttggaggatgggatatcagcaacatgaatttggcagattcaatggctagggccaaggttttggatatagatctccagaagcagctgagaccttacatggagcaaatggttccactcccaggtatctatgaccctgatttcatagctgcaaatcaagagtctcgggcaaacaacgttataggaggaaccaagaaggagcaggttgaccgcataatcaaggatatcagggagttcaaggaaaaaaaccagctggacaaggtggtggttctgtggacagccaacacagagagatacagcagtattgttgctgggctaaatgatacaatggagaatctcttggcttctgtggagaagaatgaagctgagatttctccatccactctctatgcaatagcttgtgtgcttgagaatgttcctttcatcaacggcagcccacagaacactttcgtccccgggcttattgagctggccatcaagaggaacagcctcatcggtggggatgatttcaagagtggccaaaccaagatgaaatctgtgcttgttgatttccttgttggtgctggtattaagccaacatccatcgtgagctacaaccatttaggaaacaacgacggaatgaatctatcagccccacaaacattccgatcgaaggagatctccaagagcaatgtggtggatgacatggtggccagcaatgccattctctatgagccgggcgagcatccggatcatgtcgtcgttataaagtatgtgccgtatgtgggagatagcaagagagccatggacgaatacacctcagagatcttcatgggagggaaaagcacaatcgtcctccacaacacctgtgaggattccctccttgcagctccaatcatcctggatttagtcctccttgcagagctcagcacccgtattcagctcaaagccgaaggggagggcaaattccactcgttccaccctgtggccaccatcctcagctatctgaccaaagcccccttggtgcccccggggactccggttgtgaatgcactgtcgaagcaaagggcgatgctggagaacatcctgagagcctgtgtcggtttggctccagaaaacaacatgattcttgagtacaagtgaagctggagaacgaatttggacttgactgatagtttcctcatctggggttcccttttttaattgtaatcgtgacatatgttgctatattgatgtatgctcatggttgttgtctttcaatgggtatctacgcctcttgcat

SEQ ID NO: 627 - DNA, 1538 bp, Rye
actcgagaccctctctctctcgctccaacagtctccggaaaagagagagagagggagagagatcgatcttgcgttgccaagatgttcatcgagagcttccgcgtggagagcccgaacgtacggtacggcggcgggggagatcgagtcggagtaccgctacgacaccacggagctggtgcacgagagccacgacggcgcatccaagtgggtcgtccgccccaagtccgtcaactaccacttcaagaccaacaccaacgtccccaagctcggggtgatgctcgtggggtggggcggcaacaatggctccacactcatggctggggtcatcgccaacgaggggaggggatctcagtgggcgaccaaggacaaggtgcagcaagccaactactttgggtccctcacccaggcctccaccatcagggtcgggagctacaacggagaggagatctatgcgcccttcaagagcctcctgcccatggtgaacccagatgacattgtgttcgggggctgggacattagcagcatgaacctggctgatgctatgactagggccaaggttttggacattgacctgcagaagcagctgaggccctacatggagtccatcacgccgctccccggcatctatgacccggacttcatcgctgccaaccagggctcccgggctaacaatgtccttaagggtacaaagaaagagcagatggagcagattatcaaggacatcagggagttcaaggagaagaacaaggtggacaaggtagtggtgctttggacggcaaacactgaaaggtacagcaacgtctctgttgggcttaatgacacgatggagaacctcttggcgtctgtggacaagaacgaggcagagatatccccatcaacactgtatgccatcgcctgcgtcatggagggtgtgccgttcatcaacgggagccctcagactactttgtgcctgggctgatcgatcttgctattaagaacaactgcctgattggtggcgatgatttcaagagtggtcagaccaagatgaaatctgtcttggttgacttccttgttggtgctggaatcaagcccacctcaattgtcagctacaaccatcttgggaacaacgacgggatgaacctatccgcaccgcagacattccgttccaaggagatctccaagagcaacgtggtggatgacatggtctcgagcaatgctatcctctacgagcccggggagcatcctgaccatgtcgtcgtgatcaagtatgtgccatatgttggagacagcaagagggccatggacgagtacacctcggagatcttcatggggggcaagagcacgatcgtgctgcacaacacctgtgaggactcgctcctcgcggcacccatcatccttgacctggtgctcctggccgagctcagcaccaggattcagctgaaagctgagggagaggacaagttccattcccttccgacccggttgccaccatcctgagctacctcaccaagccaccctggtcctctgcacgcggtgtgacgcctggcgagcagaggcga

SEQ ID NO: 628 - DNA, 1992 bp, Spikemoss
gcatttcctctcagctggtttcgctcgatcgatcgatcgcatcggccgctctctcccacctcgcagctcagttctcgatcggctgagctagattagctccttctattcctttgattgctcgcgtcttgcttgctcgaatatgtttatcgagagcttccgtgtggagagccccaatgtcaagtactcggaggagcacatcagctctgtgtatgattacaacaccaccgatctcgtccacgagaagaatcgcgagggcaaatacgagtgggtcgtgaagccgagcactgttacatatgaattccagactcaaaggaaggtccccaagctcggtatcatgcttgttggctgggggggaaacaatggatccacgttaactgctggaatcatcgccaatagagaaggcatctcgtgggtcaccaaggatggtgtccagcgaccaaattactttggctcagttactcaagcttctacgtgtcgaattggctcttttagaggagaggagatctatgctcctttcaagagcttgcttcccatggtgaatcccgacgatgttgttcttgggggatgggatatcaacaacatgaacctcgcagatgccatggagcgagcgaaagttttggacatggacctccagaagcagctgagaccttacatggacaagatggtgccactcccgggggtttacgaccccgatttcattgcagccaaccaaggttctcgcgcaaacaacatcttcaaaggctccaagaaagagaagatggataagatcatcgaggacatcagacacttcaagtcacaaaccaaagtggacaaagtcgtggttttgtggactgcaaacacggaacgctacagcgatgtgattgtgggcctgaatgacacgaaggagaacttgttcgcttcactcgagagagacgagcccgaaatctctccctccactatttacgccttggcatgtatccaagagggtgttcctttcatcaacgggagcccccagaacacttttgtcccaggtgtcattgactttgctgtggagaaaggaactctcatcggtggcgatgatttcaagtctggacaaacaaagatgaaatccgtgctcgtggatttcctggtcggtgctggcatcaagccaacctccattgtcagctacaatcatcttggtaacaatgatggaatgaatctatctgcgccgcaaacattcagatccaaggaaatctccaagagcaatgtggttgacgacatggtttctagcaatgccatcttgttcaagcccggtgaacatcctgatcatgtgatcgtcatcaagtatgttccttacgtcggtgatagcaagcgggccatggacgaatacacgtccgagatattcatgggaggcaggagcaccatcgccatgcacaacacttgcgaggattcgctgcttgcagccccgttgattctcgacttggtcctcctcgccgagctttgctcccggatccagctgaaaagagaaggagaggaaaagttccactctttccatccagttgcagccttgctgagctacatgacaaaagctcctctggttccccccggtactccggtcatcaatgcattgtccaagcagcgagcgtgcttggagaacgttttgagagcctgcattggattggcccccgagaacaacatgcttctcgagtacaagtgagaggatgaatggtagatggaaggatgatccaagcaaagcaaccaaagttgtgtgaagaaaaaagaaaacaatccagaaaacaatccattgttgttggagatggaggcgatcggtagtcttcgtgatgttctcgtccatcattgtaatgccgctgtggccgcagattttttcgatcaagcaagatcttgtcatttatcttctaagttcctttttctttctttttcctgggttttaaagtcccggcatttcgccatgattttagagaaagaaggttttcacttgatcgaatcagaaaacttctcggtgatctctctctc

SEQ ID NO: 629 - DNA, 1426 bp, Momordica
ttaagggatgatgctcgttggatggggtggaaacaacggctctactcttactggaggtatcatagccaaccgggaagagatttcttgggcaacgaaggataaagttcagcaagccaactattttgggtctttaacccaagcatcgtctatccgagttggctctaccgatggcgaggagatttatgctccatttaagagcctcctacccatggttaatccagatgacgttgtgtttggagggtgggacataagtgacatgaacttggctgatgccatggccagagctaaggtccttgatattgatctgcaaaagcaattgagaccctacatggaatccatggtcccacttcctggaatcttcgatcctgattttgttgctgcgaatcagggctcacgagccaataacgttatcaaaggcaccaagaaagaacaacttcagcaaattattaaagatattagggaatttaaggagaagagcaaggtggacaaaattgtagtgctgtggactgccaacacagagaggtacagcaatgttattgtggggctaaatgacactatggaaaatcttctggcttctgtggacaaaaacgagtcggagatatctccttccacattgtatgcaattgcttgtgtccttgaaaatgtccctttcatcaatggtagcccacagaacacttttgtcccagggttgattgacttagccattcatagaaatagtttgattggaggggatgatttcaagagtggtcagacaaagatgaaatctgtgcttgtagacttccttgttggtgctggtatcaagccaacatcaatagtgagctacaaccaccttggaaacaacgatggaatgaacctgtcagccccacaaactttccgatccaaggagatctcaaagagtaatgttgtggatgacatggtctctagcaatggcatcctcttcgagcctggcgagcatcctgaccatgtggtggtcatcaagtatgttccttacgtggcggacagtaagagggccatggatgagtacacctcagagatattcatgggtggtaaaagcaccatagtgatgcacaacacatgcgaggactctctcttggccgctcctatcatactggatttggttcttcttgccgaactcagcactcgcatacagttcaaggccgaagggagggaaagtttcactctttccatcctgtggctaccatcctcagttaccttacaaaggctcctcttgtaccgccaggcacaccagtggtgaatgctctgtcgaagcagcgggcgatgctggagaatataatgagagcttgtgttgggttggcccctgagaacaacatgattttggaatacaagtgaagtttgataacgttgagttgaatagaaaattggttttcttctataagtttgtgaaaatatgcagctgtttctgtct

SEQ ID NO: 630 - DNA, 2316 bp, Sorghum
agtagaaaagacaaccgatgggattccgatccgagagaatcggccgggccaggccactggcaccgcccacgaccgctcgtcagtggtcgcgctcctcccgcggcgcgccccacgtggacgccgcgcgcagagctatatataatgccctaccctttggaacctctcggatccccaccccaccccaccctgtgcacatcgtatcgttgagcgtttcgcgagtgtgaggcagcgacttctgcgttccgttccgttccgttggtgttttcgtgagaaagagagagagaacccagccaagatcgcgaagagatcggaggatgttcgtggagagcttccgggtggacagcccactggtgcagtacggcgacggcgagatccagtcggagtaccgctacgacacgaccgaggtcgtcccgccggggaatggcggtggcgcggggtggatggtgcgcccaaagtctgtcacctacaacttcaagaccagcaccaacgtcccaaagctaggttgtattgtttcaaatgatggatgcagggtgatgctcgtcggatggggcggcaacaacggcacgacgctcacggccggggtgatcgccaatagggaaggaatttcgtgggagacaaaggagaaggttcacaaggccaactacttcggctccctgacccaggcttccaccatcagggtcggcagccacaacggggaggaggtctacgcgcctttcaagagcctcgtgcctatggttgatcccaactccatcgtctttggtggatgggacatcagcaatctgaacatggctgacgccatggccagggccaaggtcctagacattcaccttcaaaagcagctcaggccctacatggaatccatgctgccactcgctggcattttcaacccagacttcgttgccgcaaaccaaggtgcccgtgctaacaatatcatcaagggcaccaagaaagagcaggtggagcagatcaagaaggacatcagggagttcaaggaaaaaaccaaggtcgacaagatagtcgtgctatggacagcaaacaccgagaggtatagcaatgtagttagtgggcttaacgacaccatggacaacctcttggcttcgttggaaaagaatgaagcagagatctcaccatccaccttgtatgcaatagcctgtgtctttgagggtgttccattcgtcaatggaagccctcagaacacattcgtgcccgggctgatggagcttgccataaaaaaaaattcggtgataggaggcgacgacttcaagagtgggcagaccaagatgaagtccgtattggtcgatttcctcgttggtgctgggattaagcccacctcaattgctagctacaaccacctaggaaacaatgacggcatgaatctctctgccccacaagtcttccggtctaaagagatctccaagagcagcgtggtggacgacatggttgctagcaatcccatcctctacaaactcaatgaacatcctgatcatgtaatcgtgatcaagtacatcccctatgtgggtgatagcaagagagctatggatgaatatacctcagagatcttcatgggtggcaagaacaccattgtgctgcacaacacctgcgaggattcgcttctcgctgcaccgatcatcctggacttggtgctcctagctgagctcagcactcggattcagctcaaggccgaagggcaggataagttccactccttccatcccgtcgccacaattttgagctatctcagcaaggctcctcttgtaccccctggcacaccagtggtgaatgctctggccaagcagagggccatgctggagaacatcttgcgggcctgcatcggccttgcccctgagaacaacatgatgcttgagcacaagtgaagagtttcacatcccctaatgaccacaagataggatggatgcaaaggagggatcaagcgaaggtgtgggaataatccgcatcctctgagcccaatgaagaaataacaggaggccacatgaagcaaaagtgtaaggaggaagatcaagcatcgatgatgccacaaacattctcttggaaggctatctgttctttcttttttagtattagatttagatttgactcattgttggtactcatgagctagattctgtacatgctatccactgtatgcagcttgaaacctttttttttgttgtgtgatagagcttatagaagtaaagtctaattttttgaactcttcgttgatttatatttttttaattgatggttgacgaacacatttgatatgtagtataaatgatagagatatcaatggggcttgattcctaacggagaattccc

SEQ ID NO: 631 - DNA, 1700 bp, Amaranthus
tccctaaacttggcgtgatgttggtaggatggggtggcaacaatggatctacccttactggtggtgtcattgccaaccgcgaggggatttcatgggcgacaaaggacaaagtccaacaagccaactatttcggatccttgactcaggcttcctccatccgtgttggttctttcaatggagaagaaatctatgctcctttcaagagcctccttcccatggtgaatccagatgacatagtgtttggaggatgggatataagtgacctgaacttggcagatgcaatgaccagggctaaagtgttggacattgatctgcaaaagcagctgaggccctacatggagcacatgattccccttcctggtatatatgaccctgattttattgcagctaatcaagattctcgtgccaataacatcattaagggcactaaaaaggagcaaattgagcaagtcattaaggacatgagggagtttaaggagaagaacaaagtggacaaggtagtagtgctctggaccgcaaacacagagcgctatagtgatgtagtggtggggctgaatgacacaatggagaacctgatggcagctgttgagaggaacgagtctgaaatatcaccatcgactttgtatgcgattgcttgtgccctcgaaaacgtgcctttcatcaatggtagtcctcagaatacatttgtccctggactcattgaactcgccattaagcacaacagtttgattggaggagatgacttcaagagtggtcagactaagatgaaatccgttcttgttgacttccttgttggtgccggtatcaagccaacttccatagtaagctacaatcatttgggaaacaatgacgggatgaacctttcagcacctcagaccttcaggtctaaagagatctctaagagtaacgtggttgatgacatggttgctagcaatggtatcttgtatgagcctggtgaacaccctgatcacgttgtcgttatcaagtatgttccatatgtgggagacagtaagagagccatggatgagtacacatccgagatattcatgggtggcaagagcacaattgtgctgcacaacacgtgcgaggattctttattggctgctccaatcatcctagacttagtcctcctcgctgagcttagctctcgtatccaactcaaggctgagacagaggacaagttccattctttccatccagtggctaccattctcagctaccttactaaagcacctctggttcccccaggcactcctgtggtgaatgcactctcaaagcagagggcaatgttagagaacataatgagggcatgtgtaggattggctcccgagaacaacatgatcctcgagtacaagtagagcgtgtgtaggcaccatagcagcagccgcaacaatttaaaggctgtgagaataagagttgttgatctgtaagcgtagaaacagtgcatgtgtagttcaagttcgtgactttgctgttgccattttcattttcaattcttcatgttttctttatgttttcaggttcataaacttttgtttttctggtgtttgtaatgtatatttgttggtggaagcatcatttagagcaagtagcttttttctgctttgccaaatcgatgtaattatcaaattcgtccttgtaccttgttggcttcgcctgtcttgaaagttttaatggaaaagtggaattaaggctttgag

SEQ ID NO: 632 - DNA, 1903 bp, Spikemoss
gggctgccgaggccccggcatttcctctcagctggtttcgctcgatcgatcgatcgcatcgggcgctctctcccacctcgcagctcagttctcgatcggctcctctagattagctccttctattcctttgattgctcgcgtcttgcttgctcgaatatgtttatcgagagcttccgtgtggagagccccaatgtcaagtactcggaggagcacatcagctctgtgtatgactacaacaccaccgatctcgtccacgagaagaatcgcgaggggaaatacgagtgggtcgtgaagccgagcactgttacatatgaaatccagactcaaaggaaggtccccaagctcggtatcatgcttgttggctgggggggaaacaatggatccacgttaactgctggaatcatcgccaatagagaaggcatctcttgggtcaccaaggatggtgtccagcgaccaaattactttggctcagttactcaagcttctacgtgtcgaattggctctttcagaggagaagagatctatgctcctttcaagagcttgcttcccatggtgaatcctgacgatgttgttcttgggggatgggatatcaacaacatgaacctcgcagatgccatggagcgagcgaaagttttggacatggacctccagaagcagctgagaccttacatggacaagatggtgccactcccgggggtttacgaccccgatttcattgcagccaaccaaggttctcgcgcaaacaacatcttcaaaggctccaagaaagagaagatggataagatcatcgaggacatcagacacttcaagtcacaaaccaaagtggacaaagtcgtggttttgtggactgcaaacacggaacgctacagcgatgtgattgtgggcctgaatgacacgaaggagaacttgttcgcttcactcgagagagacgagcccgaaatctctccctccactatttacgccttggcgtgtatccaagagggtgttcctttcatcaacgggagcccccagaacacttttgtcccaggtgtcattgactttgctgtggagaaaggaactctcatcggtggcgatgatttcaagtctggacaaacaaagatgaaatccgtgctcgtggatttcctggtcggtgctggcatcaagccaacctccattgtcagctacaatcatcttggtaacaatgatggaatgaatctatctgcgcctcaaacattcagatccaaggaaatctccaagagcaatgtggttgacgacatggtttctagcaatgccatcttgttcaagcccggtgaacatcctgatcatgtgatcgtcatcaagtatgttccttacgtcggtgatagcaagcgggccatggacgaatacacgtccgagatattcatgggaggcaggagcaccatcgccatgcacaacacttgcgaggattcgctgcttgcagccccgttgattctcgacttggtcctcctcgccgagctttgctcccggatccagctgaaaagagaaggagaggaaaagttccactctttccatccagttgcagccttgctgagctacatgacaaaagctcctctggttccccccggtactccggtcatcaatgcattgtccaagcagcgagcgtgcttggagaacgttttgagagcctgcattggattggcccccgagaacaacatgcttctcgagtacaagtgagaggatgaatggtagatggaaggaagcaaaggatgatccaagcaaagcaaccaaagttgtgtgaagaaaaaagaaaacaatccagaaaacaatccattgttgttggagatggaggggatcggtagtcttcgtgatgttctcgtccatcattgtaatgccgctgtggccgcagattttttcgatcaagcaagatcttgtcttttatcttcta

SEQ ID NO: 633 - DNA, 1934 bp, Watermelon
gcaccgcaccaacattctctatacccacttgagagagagattgagaaagagcaaaaccagggaacatttatctatttttgcgcttccttttccttcttcttccttcttcttccttcccttccttggattttgtttctttcctaatcaaattattaaaaaaagaaaatgttcatcgacagctttaaggtcgaatcccccaatgttacttactccgatcatgagattcattccatctacaattacgacactacagagctccttcatgagaatagaaacggaacctatcaatggattgtcaagcccaaatccgtccaatatcaattcaagactgatattcgtgtccccaaattagggatgatgctcgttggatggggtggaaataacggttctactctcactggaggtatcatagccaatcgggaagggatttcttgggcaaccaaggataaagttcagcaagctaattattttgggtccttaacccaagcatcatccatccgggttggctctattgatggtgaggagatctatgctccctttaagagcctcctacccatggtcaatcctgatgatattgtgtttggagggtgggacataagtgacatgaacttggctgacgccatggctagagctaaggtccttgatattgatctgcaaaagcagttgaggccttacatggaatccatggtcccgcttcctggaatctttgatcctgattttgttgctgccaatcagggctcacgagccaataatgttatccaaggcaccaagaaagaacaactccagcaaattattaaagatatcagggaatttaaggagaagagtaaggtggacaagattgtagtgctgtggactgccaacacagagaggtacagtaatgtgattgtggggctaaatgacacaatggaaaatcttctggcttctgtggacaaaaacgagtcggagatatctccttccacattgtatgcaattgcttgtgtccttgaaaatgtccctttcatcaatggtagcccacagaacacttttgttccagggttgattgacttagccattcatagaaatagtttgattggaggggacgattttaagagtggtcaaaccaagatgaaatctgttctggtagacttccttgttggtgctggtattaagccaacatcaatagtgagctacaaccatctgggaaacaatgacggaatgaacctctcagcccctcaaaccttcagatccaaggagatctcaaagagtaacgttgtcgatgacatggtctccagcaatggcattctctatgagcctggcgagcatcctgaccatgtggtggtcatcaagtatgttccttacgtgggggacagtaagagagccatggatgagtacacttcagagatattcatgggtgggaaaagcaccatagtgttgcacaacacatgtgaggactctctcttggccgctcctatcatactcgatttggttcttcttgctgaactcagcactcgtattcaattcaaggccgaaggagaggttagtttcactctttccaccctgtggccaccatcctcagttaccttacaaaggctcctcttgtaccgccaggcacgcctgtggtgaacgctctgtcgaagcagcgcgcgatgctggagaatataatgagagcttgtgttgggttggcacctgagaacaacatgattttggaatacaagtgaagtctgaaagcgtttgagtttgatagtaatttgttttcttctctaagtttgtgaaaatatgcaattagtttctgtttggtcccttttcctctttttcttttcctttctttttagccctctttttgtattcggcttggggaagctgcttaatcttgggcaagctatatctgtaatggaattataataaaattagatctttatgtttttggtaaagcaacgcttaacataactgattct

SEQ ID NO: 634 - DNA, 2061 bp, Soybean
acaccacaactccaaacttttcctcttattctcttcttcaacacaactagcttagtcttataatccagctcatctctctctccaaaatggctctacactacccttttccaacctacttcatactactactagtaaccataacccgtttgatatacaccgtgggaaaaaccgagcaatggaaagctccgattctaacagagcttgacattaataacatatcccacaaactccatgatgatcctgaaatcattcaaatggcttcaagggactatggccacatcgtgcatgaattcccattagctgtgtttcgtccatcttctatagacgacatagccaccttgataaaatcctcctacaatagctttgccccttttggcatagctgcgaggggccaaggccactccactcatggacaagccatggctcgtgatggggttgtggttgacatggccaacctcagaaaacaaagaaatggggttgcgattagtgtctctaaggaccctttgatgggtcactatgcggatgttggaggggaacaactctggattgatgtgctacataccacacttaaacatggacttgcaccagtttcttggactgattatttgtacttgaccgtgggagggacactttccaatgctggaatcagtggccagagcttccgttatggacctcaaatcagcaacgttcatgaaatggatgtcatcactggaaaaggagagttcgtaacttgctcttcacagaagaacttggagttattccacgcggttcttggaggcttagggcaatttggagttatagcaagggcgagaatagcacttgagccagcccccaaaagggttaagtgggtcagactactttatagtgacttttttgcttttaccaaagatcaggaacgattaatctcaatcaatggaaggaaacaaaagaacgcattggattttctggaagggatgctgctaatgaaccaaggccccataaataattggagatcctctttcttccctctatctgaccatcccagaatatcttctttaataactgaacatagcatcctctactgtcttgaagtggctaaatattatgacgaacaaaccgagataaatgtggacaaggaaattcaagttttgctccaaggactagcctatatccctgggttttattatgagaaaaacgtgtcgtacgttgagttcttgaatagggtccgaagtggagagttgaagcttcagtcacaaggactgtgggatgttcctcacccatggcttaatttgtttataccaaaatctcaaatcttggattttaattcaagagtattcaaagatatagttcttaaaagaaacatctcctctggaccagtcttggtttaccccacgaatagaaacaagtgggacgataggatgtcagcatctataccagacgaggaggttttctacacagttggatttttgcactcaagtgggtttgatacttggaaagcatatgatgctcaaaacagtgaaattttggagttctgtagagatgctggcatcaaggtcaagcaatatcttcccaaccacagcacacaggaagattggacaaaccattttggtgctaaatggataaaattcttagaaagaaaacatcagtttgatccaagaatgattctatcaccagggcaaaaaatcttccacaaacaattacagccagcgttttaaatatttcccctaattaaaaaaagtaaatgttttatggtgggactaccccatttagatggctacctagggacaggtgtaaatacaatgagaccaagaccaagatggctttaatttgtatgttaaactttgcattgctagagaaattaataaggtgcatgagtactttggcacctattatgctacatataccttagatacgttataggttgacaaagtcgtactggtaggttcaagaagcacagttgtctctcacattgtctgtcacccaacttgctatagtgtgtggagaaattcggatcatattgaagatgttctaatgagttccagtccttcattaagtgtttaacgattctgtctttctttatat

SEQ ID NO: 635 - DNA, 1991 bp, Bean
ctctctctctctctctctctctctctctctctctccaaaaaaatggcactgaattacccttcttcaacctacttcatactactagtagtaaccataacccgtttgatatacacggagggcaaaaccgagcaatggaaaggtctgattcttccagatcttgactttgaaaatatattccataagcttcacgatgaccctgaaaccattcaaatggcttctagtgactatggtcatatcgtgcatgaactccctgcagctgtgtttcatccatcttccatagaggacatagccaccttgataaaatcctcatacaacagccttgccccttttcacatagccgcgaggggccaaggccactcccatcatggacaagccatggctcgtgatggggtggtggttgacatggccaccctgagaaaacaaagaaatggggtttcgattagtgtctctaaggaccctttgataggtcactatgctgatgttggaggggaacaactctggattgatgtgctacatgcctcactagaacatggacttgcacccgtttcttggactgattatttgtacttgaccgtgggaggaacgctttccaacgctggaattagtggccagtctttccgctatggacctcaaatcagcaacgttcatgaaatggatgttatcactggaaaaggagagttcgtaacctgctctacgcagaagaacttggagttattcaacgcggttcttggaggctttggacaatttggagtcatagcaagggcgagaattgctcttgagacagcacccaaaagggttaagtgggtcagactactttatagtgacttttctgcttttaccaaagaccaggaacgattaatctcaatcaatggaaggaaacaaaagaatgcattagattttttggaagggatgctgctaatgaaccaaggccccataaataattggagatcctctttcttccctctatctgaccatcccagaatagcttctttaataactgaacatggcatcctctactgtcttgaagtggctaaatattatgacgaccaaaccgagaaaaatgtggacaaggaaattcatgtgctgctccaagggctggcctatatccccggattttattatgagaaaaatgtctcatacgttgagttcttgaatagagtccgaagtggagagttaaagcttcagtcacaaggactgtgggaggttcctcacccatggcttaatttgtttttaccgaaatctcaaatcttggattttaattcaggagtattcatggatataattcttaaaagaaacatctcctctggaccagtcttggtttaccctatgaatagaaacaagtgggacgataggatgtctgcatcaataccagacgaggatgtcttctatacagttggatttttgcactcgagtgggtttgattcttggaaagcacatgatgctcaaaacagagaaattttggagttctgtagggatgctggcattaaggttaagcaatatcttcctaaccacagcacacaggaagattggacaaatcatttcggtaccaaatggttgaaattcttagaaagaaaacaccagtttgatccaagaatgattctatcacccgggcaaaaaatcttccacaaacaattacaaccagcgttttaaatattccacaatgaaaaacaaaaaaaaagtgtttatggagggactatttctcaattagatggctaggggctggtgtacatactatgataatcgaaaccaaaatggccatttgtatgtttttgctagagaaattaaggtagggtataaaatgatactaatatttcggtaccttagatatagattatgttagcaaagtcttactcgtatgtacaagaagcacagttgtttctcacatggtctgtcactcaaccttctagtacggacaaaatataatgaagatgttctaaggagttctggtcctcccttaaatgtgtaacgattctgtattaatttctttatat

SEQ ID NO: 636 - DNA, 2086 bp, Pigeonpea
accacaacaccaaacttttcctcttcttctcttcctcttcaacacagctagtcataaccctcctctctctctctctctctcttcaaaatggctctaaaccaccctctttcaacctacttcatactactgctgataaccataacccgtttgatatccattgtaggtaaaaccgagcagtggaagaaagctcctattctacaagagcttgacattgacaatatatcccttaagttccacgacgaccctgaaaccattcaaatagcttctagggactatggcaacatcgtgcatgaattcccaagatctgtgtttcgtccatcttccatagacgacatagtcaccttgataaaatcctcatacaatagcccttccccttttcacatagctgcgaggggccaaggccactccaccaatggacaagccatggctcgtgaaggggtcgtggttgacatggccaccctcagaaaacaaagaaatggggttgccattaatgtctctaaggaccctttgattggccactatgctgatgttggaggggaacaactttggattgatgtgctacattccacgcttgaacatggacttgcaccagtttcttggactgattatttgtacttgaccgtgggagggacactttccaatgctgggattagtggccagagtttccgttatggtcctcaaatcagcaacgttcacgaaatggatgtcatcactggaaaaggagagttcgtaacatgctcttggcagaagaacttggagttattccacgcggttcttggtggcttaggacaatttggagttatagcaagagcgagaattgctctcgagccagcccccaaaagggttaagtgggtcaggctactttatagtgacttttctgcttttaccaaagaccaggaacgattaatctcaatcaatggaaggaaacaaaagactgcattggattttctggaagggattctgctaatgaaccaaggccccataaataattggagatcctctttcttccctatatctgaccatcctagaatagcttctttaatcactcaacacagcatcatctattgccttgaagtggctaaatattatgatgaccaaaccgagaaaaatgtggacaaggaaattaaagttttgctccaaggactggtctatatccctggattttattatgagaaaaatgtctcatacgttgagttcctgaatagagtccgaagtggagagttgaagcttcagtcacaaggactatgggatgttcctcacccatggcttaacttttttataccaaaatcacaaatcttggattttgattcaggagtgttcagagatatagttcttaaaagaaacatctcctctggaccagtcttggtttaccccatgaatagaaacaagtgggacgataggatgtcagcatctataccagaagaggatgtgttctacacagttggctttttgcactcaagtgggtttgataattggaaggaatatgatgctcaaaacagagaaattttggagttctgtagtgatgctggcattgaggttaagcaatatcttcccaatcacacaacacaagaagattggtcaaaccattttggtgctaaatgggttacattcttagaaaggaaacgtcagtttgatccaagaatgattctatcaccagggcagaaaatcttcgacaaacaattacaacaagcattttaaatattttaattccaattcccctaataaataaaacaagtaaattgttatggtgggactaccttaattagatggctagctaggcacatggttttgtacatactaccaagagtatgtttttgctgtaaaatttaatgtggggttataattaaagtggctttggcgtctatcatgctacatacttatatatcttagatatgttaggttgacaaagtcgtatgtacaaggagcacagttgtctcttgcattaattgtctgtcacccaacttgctaggtagataaggatcgtattgaagatgttccaattaaggagttttaagggctttgtctttctttatatgaatgattacttttgtactggggcaaacatataaatgatttttagttaatt

SEQ ID NO: 637 - DNA, 1772 bp, Cowpea
ccgtttgttccgcagccaccattttgggctccggcaatgcttttcacggtggctgtcgtaccctaaacccatcacttcacagtcatggggataccatgggacgacgtcgttgtgatccagcaagggaaggacctcaatgagccctgtatcgtcaccgtcaattgccccgacaaggctggtctcggatgcgatctttgcagaatcatcctcgagttcggtctccgcattacccgcgccgatatttccacggatggaaggtggtgctacatcgtgttttgggttcttccaaatccagcatctatcaaagttgattgggagagtttgaagactcgcctcctttcagtttgcccttcatgtttgttttcttatcacttcaatcaactctcaacaagtccttcaccgccactgatttacctgttgaaggtttggtgtgttgatcaaaaagggttgctacatgatattaatgaaatcctgtgcaaccttgaattaattattcagagagtcaaagcgatgccaaccccagatggcagggtgttagacatgttctttatcacagatgggatggaattgcttcacacgaaaaagagacaagattatgtgtgtgaatctctaaaggacgctttaggagagaggtgtatctccagtgaacttcaattggctgggcctgaatatggacacctgcaggggttttcttctcttccaccagcttttgctgaagaattatttagttctgagctgctggacaaggtgtctttgcatccactcagccaagatatgaaaacactgaagacacctactgttactgtagataattcactgagcccagttcataccttacttcagattcagtgtgttgaccagaagggtctgtgttatgacattatgaggatttctaaggactctgatattaaggttgcttttggtcgattttcatcaagcgtggagggctttagaaacatagacttatttgttcagcaaaatgatgggaaaaagatcatagatcctgatagtcagaaaaccctatgctcatgcttaaaagaagagatgcttcatcctttgagggtgatcatagcgagccggggtccagacacagaacttctggttgctaatcctgtggagctttctggaaagggaaggccccgtgtgttctatgatgttacattggctttaaaagctttgggagtatgcattttctcggctgaagttgtaagacattcaacgcaagagcgccaatgggaagtgtatagatttttgttggaggaaaaccgtaacttcccattgaccagaagccaaacaagaagccagattgtggacaaagtaagaaggacattgatgggttggtaatttggctcagtacaaaagaaaaacactttggtgtggtgtgcgttttctaatccctctttgttaattacaacttgcttttttctttttaatatggtttaggcaaaatcaacaacaatcatgtaatttagcattgtagacgatcttatgtttcttttctttggctctagtgatacattttctgtatattggttttcatcattttgtaaaaaattagactctttcaattaactaccaaggaactagatttccttctctggaagcttgaatctttccccatcataacacattgttcattgaagatgatcaatgaaatattaatactaggagaatgtcacagaatacgatttcaaaatttcaaatataaaatagtagaaagaagggctaacacggtaaagtgcattcctttcacactgtattaaatattttgt

SEQ ID NO: 638 - DNA, 1703 bp, Bean
ttcagtcttccacaagtttcattcacagtttagttttgttcctcagccgccattttgcgctccggcaatgcttttcacggcggcgctcgtcccctaaacccaccacttcgcagtcatggggataccatgggacgacggcgttgtgatccagcaagggaaggacgccaatgagccctgcatcgtcaccgtcaattgccccgacaaggctggtctcggctgtgatctctgcagaatcatcctcgagttcggtctccgcattacccgcgccgatatttcaacggatggaaggtggtgctacatcgtgtattgggttcttccacatccagcatctgtcaaagttgattgggagagtttgaagactcgtctgctttcagcttgcccttcatgtttgttttcttattgcttcaatcaactctccacgagcccttcacctcctccgatttacctgttgaaggtttggtgtgttgataagaaagggttgctacatgatattaatgaaatcctgtgcaaccttgaacttattattcagagagtcaaagccatgccaaccccagatggcagggtgttagaaatgctctttatcacagatgggatggaattgcttcacacgaaaaagaggcaagatcatgtgtctgaatttcttatggacgctttaggagagaggtgtatctccagtgaacttcaattggctgggcctgaatatggacatctgcaggggttttcttctcttccaccagcttttgccgaagaattattcagttctgagctgctggacaaggtgtctttgcatcctctcagccaagatatgaaaacactgaagacacctactgttactgtagataattcactgagcccagttcataccctacttcagatacagtgtgttgaccagaagggtctgtgttatgacattatgaggatctctaaggactctgatattaaggttgcttttggtcgattttcttcaagcgtggagggctttcgaaacatagacttatttgttcagcaaaatgatgggaaaaagatcatagatcttgacagtcagaaaaccttatgttcatgcttaaaggaagagatgcttcatcctttgagggtgatcatagtgagcaggggtccagacacagaacttctggttgctaatcctgtagagctttctggaaagggaaggccccgtgtattctatgatgttacattggctttaaaagctttgggaatatgcattttctcagctgaagttgtaagacattcaacgcaagaacgccaatgggaagtgtatagatttctgttggaggaaaaccgtaacttcccattgaccagaagccaaacaagaagtcagattgtggacaaagttagaaggacattgatgggctggtaatttggttctctgtacaaatgaaaagcacttttggtgctgtgtgccttttttaatccctttttcttaaatttcaacttactttcttttgaatatggtttaggtagcaggcatatagtcaactacaatcatgtaattttagcattgtagacggtctcatgtttcttttctctcgctttagtgatgaattttctgtaaattggttttatcattttgaaaaattagatgctttgaatcaactaccaaggaagcttgaatatttcacacggccaagtttagtagaggtagatttttctcacattccaacatattcttcattcaaagttgaaga

SEQ ID NO: 639 - DNA, 1711 bp, Pigeonpea
ttcagccttccacagatttcgttccatgattcagtttttttgttcttcaccaaccacgttcttcgccggagcctccattttttagctccggcaatgctcttcgcggtggccgtcgtcccctgaactcaccacttcccagtcatggggataccgtgggacgacgtcgttgtgatccagcaagggaaggaccccggcgacccctgcatcgtcaccgtcaattgccccgacaaggccggtctcggctgtgatctctgccaaatcatcctcgagttcggtctccgcattacacgcgccgatatttccacggatggaagatggtgctacatcgtgtattgggttgttccacatcctgcatcgctcaaagttgattgggagagtttgaagattcgccttctttcagcttgcccttcatgtttgttttcctattacttcaaaaactccacgtgtccctcaccgcctccagtttacctgttgaaggtttggtgtgttgatcaaaaaggattgcttcatgatattaatgaaatcctgtgcaaccttcaacttatcattcagagagtcaaagcgatgccaaccccagatggcagggtgttagacatgttctttatcaccgatgggatggaattgcttcacacaaagaagaggcaagattatgtatgtgaatatttgaaggaagctttaggagagaggtgtatctccagtgaacttcagttggctgggcctgaatatggacatttgcagggtttttcttctcttccaccagcttttgctgaagaattatttagttctgagctgttagacaaggtgtctttgcatcctctcagccaagatatgagaacactgaagacacctactgttattgtggataactcactgagccaggctcataccctacttcagatccagtgtgttgaccagaagggcttgtgttatgacattatgaggatttctaaggactctgatattaaggttgcttttggtcgattctcttcaagtgttaaaggctttcgaaacatagacttatttgtccagcaaaaagatgggaaaaagatcatagatcctgagagtcagaaaactttgtgttcaagcttgaaagaagagatgcttcatccattgagggtgatcatagtgaaccggggcccagatacagaactactagttgctaatcctgtggaactgtctggaaagggaagaccccgtgtattctatgatgttacatctgctttaaaggctctaggagtattcattttctcggctgaagttgttagacattcaacacaagaacggcaatgggaagtgtatagatttttgttggaagaaagccgtgagtttccattgaccagaagccaagcaagaagtcagattgtggacaaagttagaagaacattgatgggctggtaatctgtttcagtatcaaatgaaaagcactataagttcagtgtgcctttatgttatttaaatctcaacttggtttaccctttaaatatggtttaggtagcatgtatctaatcaacgacaatcatgtaattttatatgattttagcattgtagatcatcttataagttttctgtacattgattttatgttcagcataattctttatgccaaatctggatttccttctcatgacatgggctccaataaatctggccttctagtatagggtagatatctttcgttattctaaaatattgttgattcaagatgtcgaat

SEQ ID NO: 640 - DNA, 1360 bp, Lotus
ctccaacctcccaacaccattggccggagccaccgctgcgagctccgacaatgctctttccggcggccattctcccgtgaagctacaccacttctgagtcatgggaataccctttgaagacctcgttgtgatccgggaggggaagaacctcgatgaaccctccgtcgtcacggtcaattgccccgacaaagctggccttggctgtgatctttgcagaatcatcctcgagttcggtcttcgcgttaccagagctgatgtttcaacggatggaagatggtgttacatcgtgtattgggttgttccacatcctgcatctctcaaagttgattgggaaagcttgaagacacggttactttcagcgtgcccttcctgtttgttttcctattacttcaatcaacagtctaccactccttcaccgcctccaatttacgttttgaaggtttggtgtgttgatcagaaaggattactacatgatattaatgaaatcctttgcaaccttcaacttattattcagagagtgaaagcgatgccaaccccagatggaagggtcctagacttgttctttatcacagatggaatggaattgttgcatacaaaaaagaggcaagactacgtatgtgaatatctgatggatgctttaggagagaggtgtatctccagtgaacttcagttggccgggcctgaatatggacagattcaggggttttcttctcttccaccagcgtttagtgaagaattatttggttctgagttattagacaaggtgtatatgcatccgctcagtaaagatatgacaacattgaaaaaaccaactgttatggtggacaattcattgagcccagttcataccttgcttcagatacagtgtgttgatcagaagggcttgtgttatgacattatgaggatttctaaggactctgatattaaggttgcttatgctcggttctcttctagtgtgaaaggctttcaaaacattgacttatttgtccagcaaaatgatgggaaaaagatcatagatcctgaactccagaaaactttgtgttcttgcttgaaagaagagatgctccatccattgcgggtgattatagtgaatcgtggtccagatacagagctactggttgctaaccctgtggagctgtctggaaagggaaggccccgtgtgttctatgatgttacattggccttaaaagcattgggagtattcgttttctcggctgaagttgtgaggcattcaacacaagaacgccagtgggaagtgtacaggtttttgttggatgaaagccatggatttccattgaccagcagcaaagctagaagtcagattgtggacaaagttagaagaacattgatggggtggtaa

SEQ ID NO: 641 - DNA, 1842 bp, Peanut
ggttcattaatgtgtgttgcatttcatagttgtcctgtcctatattttctctctctctctctcaccaaccaaccaacacaaacatcattcgttggagccaccattgccagctccggcaatgctcttgcatacggtggtgcagcgctgaaccttctcgaaaccctctcgtaaaggagaggcttcatatcttcagccgccatgggaataccttgggatgacgtcgttgtaatccagcatggaaaagacaaaaatgaccccaccgtcgtcaccgtcaattgccccgacaaggctggcctcggttgtgatctctgtagaatcacccttgagtttggtctccgtatcaaaaaagctgatatttcaacggatggaaggtggtgctacatagtgttttgggttgttccaaatccatcatcactcacagtagattggggaagcttgaagacaaggctcctttcggcttgcccttcatgcttgttgacttatcacttgaatcaacagcttactactagtccttcgccgccgccaatttacttgttgaaggtttggttaatcgatcagaaaggattactacatgatatcaatgaaatcctatgcaaccttgaacttcttattcagagagtcaaagtgatgccaaccccagatggcagggctttggacatgttctttatcaatgatggaatggagttgcttcacacaaaaaagagacaagattacgtatgcgagtttctgaaggatgctctaggagacagatgtatctccactgaacttcagttggccgggcctgaatacggacagcttcaagggatctcttctcttcctccagcatttgccgaagaattatttagttcagagctattagacaagggctctttgcatcctctcagccaagatatggcaccattgaagaagccgactgttatggtggataattcactgagcccggctcataccttgcttcagatagagtgtgttgatcagaagggattgtgttatgacattatgaggatttctaaggactctgatattaaggttgctcatggtcgattctcttcaagcgcaaaaggcttccgaagcattgacttactggtccagcaaaaagatggcaaaaagatcatagatcctgaaagtcagaaaactctatgttcttgcttaaaagaagagatgcttcatccattgcgggtaatcatagtgaaccgtggaccagacacagaactactggttgcaaatccagtagagctgtctggaaagggaaggccgcgagtattctatgatgttacgctcactttaaaagcgttgggagtaatgattttctcggctgaaattgtgagacattcgacacaagaacgccagtgggaagtctaccggtttttgttggacgaaagccgtgactttccattgacgagcagcaaagcaagaagccagattgtggacaaagtgagaagaacgttgatgggatggtaaatttggttttgggtttgttcctttttcatatgagaggagcactatgtgtgtgtatttaaatagctttctttaaacttggtttctcctctaaatttggtttaggaagcttaacaactatcatatgattttagcatttgtatatgtatcattttttatttggttttagtaatatttttttgtacattgtgtgtgttgggggtgtttttatttttttgttgagcttctaatatagtaatatttcattgaggcttgatcatagaatgtggtcgaaaatatggttggtccgagattaaatgagctggaattttggcctcttcaaattagaggggccaattcttggggtcttacaataagggctttcctgtgtctcattgtttactt

SEQ ID NO: 642 - DNA, 1639 bp, Medicago
gttcttctcttcttcttctcaaaccattcgccggagcaaccttcgccggagctccggcaatgctattatccaaccactgaattcaccgtttctcagtgatggggataccatcagacgacctcgttgtgatccagcatgccaagaatgcaaatgaaccaaccattgtcactgtcaattgtcctgataaagctggtcttggctgtgatctttgcagaatcatccttgaatttggtcttcgtattactagagctgacatttcaacggacggaagatggtgcttcattgttttttgggttattccacatccagcatcactcaaaattgattgggaaaacttgaaaacaaggcttctatcaccttgtccttcatgtttgttttcttataatttcaatcaacgaaatccttcaccacctccaatttacttgttgaaggtttggattattgatcagaaaggattactacatgatattaatgaaatcttgtgtaaccttcaacttactattcagcgagttaaagtgatgccaacaccagatggaagggccctagatttgttctttatcactgatgaaatggaactgtttcacacaaaagagaggcgagacgatgtatgtcaatatcttagtgaagctttaggagagaggtgtatctccagtgaacttcagttggccgggcctgaatatggacatttgcagggtttttcttctcttccaccagcttattctgaagaattatttggtcctgagttggtagacaaggtctctttgcatcctctcagtcaagacatgacgacactgaagacaccaactgttacagtggacaattcgttgagttcagttcataccttgcttcagatacagtgtgttgatcagaagagcttgtgttatgaccttatgaggatttctaaggattctgatattaaggttgcttatggtagattcaattcaagtgcgaaaggctttcaaaatattgacttatttgttcagcaaaaagaagatgggcaaaagatcatagatcccgaacgtctcaaaactctgtgtacctgcttaaaagaagagatgcttcatcctttgcgggtgattatcgtgaatcggggtccagatatagaactgctggttgccaatcccgttgaactgtccggaaagggaaggcctcgtgttttctacgatgttacgttggctttaaaagcattgggagtattcattttctcggctgaagttgttaggcattcgacacaagaacgccagtgggaagtctaccggtttttgttggacgaaagccgggattttccactgaacagcagcaaagctagaagtcagattgtggacaaagttagaagaacattgatgggttggtaatctggttcagttcatatcagataagaaacactgtttcagtatttgtgctggtgtccctttttaagttactttccctatttataccaacttggtttactgtttcaacttggtttaggtattagttatctaactaatcatgtaaatttggctttctggtagattattttacgtctcttttctttgacttcagtgaaaagttttctctatataggttttctatgcaagtgcgtagaccaatgtttttgaaaccgaacatcaaaccagcgaaacttctgtgtttcaaa

SEQ ID NO: 643 - DNA, 1997 bp, Soybean
actcaataaaatggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgagaatcatcaatgctgcactcaatgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctggtgtaggaaattatgatcccaaaacggatcaaaataactttaatcttgcggatcctgttgagaggaacacaattggagtgcctactggagggtgggttgctttcagattcagagcagataacccagtgtggttcttgcactgccatttcgaggtgcatacaacatgggggttgaagatggcattcttggtggacaatggtaaaggtcctaatgaatcactgctacccccaccaaaagatcttccaaaatgttagacttttcagtcatcgattgaacaacacacagacaagggaacaacacacagacaagggaaggatacagagaagctaggaaaaacaagagaataaaggggatggtggttatttaataagcaggatgtcccacttgcctttttgagctaatgggagcatttcttcacagtaggttggagtcagcattttggttttctttgaacatacacttttttcttgttaaagcgattcagatcatattcatatgtattgagatcgaccctgcataatttggttatttactgaaataaatctgtcacgttcttcatgg

SEQ ID NO: 644 - DNA, 2002 bp, Bean
actcaataaaatggactcttgggttagagtgttgcttttcattgcttgcattgttcctgctttggttgagtgcaaagttaggcactacaaattcaatgtggtgctgaagaataccactagattatgttcaagcaaacccattgtcaccgttaatgggaagttcccaggacccactctttatgccagggaagatgatacagtgctggtcaaagtcagaaaccttgtcaaccacaatgtcactatccattggcatggtgtgagacaaatacgaactggttgggctgatgggcctgcatacatcacacaatgcccaattcttcctggacaatcatatttgtacaacttcacccttacaggacaaagaggaacacttctttggcacgctcatgttaattggctaaggtcaactctccatggtgccatagttatcttgccaaagcatggtgtaccataccctttcccgaaacctgttaaagagttagtggtaatattaggagaatggtggaaatctgatactgaagatgttatcaatgaagctctcaagtcaggattggcaccaaatgtctcagatgctcacaccattaatggacttccagggattgtgtttgtggccaattgttccacacaagatgtgtacaagcttcccgtggaaagtggcaagacctacctattgagaatcatcaacgctgcactcaatgaggagacttttttcaaaattgctggccatttattcactgtggttgaagttgatgcctcatatgtaaaacccttcaagactgatactcttttgatagcccctggccaaaccaccaatgcccttttaactactgaccaaaattctggtaaatacacaattgtagcctctactttcatggattctccagtcgtagctgtggataatttgactgctacagccacattgcactatactggaactcttgccaccactcctacagttctcatcacacctcctccaagaaatgctacacaagttgctaacaatttcaccaagtctcttaaaagccttaattccaagaaataccctgcaaatgttccattaacagttgatcattcacttctctttactgttggattggggattaacccttgtccatcatgcacagctggtaatgggagtagagtagtggcagctgtcaataatgtgacatttgtgatgccaaccactgcattgcttcaagcacattacttcaacactcaaggggtgttcaccactgatttccctggcaaccctcctcaagtttacaactacacagcgactccgcgggctgcgagttcccagaccacaaatggcactaaggtttacaggctagcattcaactccacagttcaggttgttttgcaggatactggagtcattgctcttgagagccacccaattcatcttcatgggttcaatttctttgttgttggctcgggtgtaggaaactatgatcccaaaacagatggaagtaactttaaccttgtagatcctgttgagaggaacacaattggagtgccaactggaggatggattgctctcagattcagagcagataatccaggagtgtggttcttgcactgccatttcgaggtacatacaacatgggggttaaagatggcattcttggtggacaatggtaaaggtcctaatgaatcattgatagccccaccaaatgatcttccaaaatgttgagaatttcgaccatcaataaaataacacaaaaaaaagggaaggccttcttcctatgcaaaaagaacctttggaaagatacaacgaagctaggcagaagaagagaatgaaaagtgagggtgattatctaataagatgttgtcccaatagctttctgagttaatgggagcatttcttcacacacattctggttttctttgcacatacacttcttttctttattttttgttaaagctatacagatcatatgtattgagatcaatgagtgcatactttgcttactaaatgaaatagaagttttacttcattcat

SEQ ID NO: 645 - DNA, 2203 bp, Pigeonpea
agtcatgcatgaatgcacttaagcacataagtaataattattacaagtaagttgacacaggcgaatcaggtggtgaagattgaatgaaatggattcttgggttagaatgctgtttctcattgctttcatcgttccagctttagtcgagtgcaaagtgaggcactacaaattccatgtggtgctgaagaatactacaaggttgtgttcaagcaaagctattgtcaccgttaatggaaagtttccaggacccactctttacgctagggaagatgatacagtgttggtcaaagtcagaaaccttgtcaaccacaacgtcaccatccactggcatggaataaggcaactaagaactggttgggctgatgggcctgcatacatcacacagtgcccaattttgccaggacaatcatatttgtacaacttcaccattacaggacaaagaggaacacttctttggcatgctcatgtgaattggctaaggtcaactctccatggtgccatagttatcttgccaaagcgtggtgtgccataccctttcccaaaaccagataaagaattggttgtaatattaggagaatggtggaaatctgatactgaagatgttatcaatgaagctctcaagtcaggactggcaccaaatgtctcagatgctcataccatcaatggccttccagggattgtgtctgtggctaattgttctacacaggatgtgtacaaacttcctgtggaaagtggcaagacctacctactgagaattatcaatgctgcactcaatgaagaactttttttcaaaattgctggtcattcactcactgtgattgaagttgatgcctcatatgtaaagcccttcaaaaccgacactcttctaatagcccctggccaaaccaccaatgcccttttaactgctgaccaaaattctggcaaatacatcatagtagcctctactttcatggatgcttctgtggtagcaatagataacttgactgctacagccacactgcactacacaggcactcttgcaagcacccctacaattctcaccacccctcctccaagaaatgctacacaagttgctaccaacttcaccaagtctcttaaaagccttaattctaagaaatacccagcaaatgtgccactaacagttgatcattcacttttgttcactgttggattggggatcaacccatgtccttcttgcactgctggcaatgggagtagagcagtggctgctgtcaacaatgtgacatttgtgatgccaaccactgcattgcttcaggcacattacttcaacatcaagggggtgttcaccactgatttccccggcaaccctgctcatgtttacaactacacggcgactccggcaacggcgagttcgcagacgaaaaatggcaccaaggtttacaggctgaaattcaactccacagttcaagttgttttgcaggatactggggtcattgctcctgagagccacccagttcatcttcatgggttcaatttctttgctgttggctctggtgtaggaaactatgaccccaaaacgggtccaaataactttaaccttgtggatcctgttgagaggaacacaattggagtgccaactggaggatgggttgctattagattcagagcagataacccaggtgtgtggttcttgcactgtcatttcgaggtgcatacaacatgggggctaaagatggcattcttggtggacaatggtgaaggtcctaatgaatcattgatacccccaccaaaagatcttccaaaatgttgagactttcagccaataattgaataacacaaataaaaggaaaggcctttcctttgcaaaatgaagcttcggaaggatacagagaagccaggcaaaagaaagcgagggtcgttatttaataataagcgggttgtccaaattgttttatttttttgagttaatagcaggatttcttctcgcacgttctgtagattggagctatcattttgattttctttgcacattcatttattgtctttagtttttgttatagctatactgatcatatgtattgaaaacaatgagtgcaggtaatttaattgaaataaaaatggtacttgcttcattcaatacatgttcattgggtgacgagtatttcataattctttgcattaagaagacatgttcatatgtatcacaactcaaaataatagatccttgcagacttgcagagaa

SEQ ID NO: 646 - DNA, 2110 bp, Pigeonpea
gcaacacacaaggacataacgttgtacaacaaactaagacagggcctaagggaaagggtagagaggaaatggattctcattgggttcgaatcatacttctcattgcttgcattcttccagctttggtcgaatgcagagtgaggcactacaaatttcatgtggtggccaaaaaaactactagattgtgttcaagcaaatctattgtcaccattaatgggaagttcccaggacccactctttacgccagggaagatgatacagtgctggttaaagtcatcaaccaagtcaaccacaacgttaccatccattggcatggtgtgaggcaattgagaactggttgggctgatgggcctgcatatgtcacacagtgcccaattcaaccagggcaaacctatgtgtacaatttcacccttacaggacaaagaggaacacttctttggcatgcacatgttaattggcttaggtcaactctccatggtgccttagttatcttgccaaagagaggtgtgccgtatcctttcccaaagccagatgatgaattggttgttgtattaggagaatggtggaaatctgataccgaagctgttatcaatgaagcacttaaatcaggattggcaccaaatgtctcagatgctcataccattaatggccttccagggacagtgaccaattgctctacacaagatgtttacaacttgcctgtagagagtggaaagacctacctggtgagaattatcaatgctgcactcaatgaagagctcttcttcaaaattgctggccacaaactcacagtggtggaagttgatgccacatatgtaaagcctttcaagattgaaacaattgtgatagcccctggccaaaccaccaatgtgcttctaactgctgaccaaaaatctggcaagtacttagtagcagcttctccctttatggatgctcctgttgctgtggacaacttgactgccacagcaacattgcactacacaggcactcttgccaccacccccacaattctcacaaccccacctcaaaaaaatgcaacacaagttgctaacaacttcatcaactctctcaaaggccttaactccaagaagtaccctgtcaatgtgccattaacagttgatcattcacttttcttcactgttgggttggggatcaacccttgtccttcttgcaaagctgggaatgggagcagggtggtggctgctgtcaacaatgtgacatttgttatgccaaccattgccttgcttcaggcacattatttcaacattggtggggttttcaccactgatttccctgctaaaccaccccatgtgttcaactactctgggactggaccagcaaatttgaacaccaccagtggcacaaaactttacaggcttccattcaatgccactgttcaagttgttctacaagatactggaatcattgcacctgagaaccaccctgttcatcttcatggcttcaatttctttattgttggaagaggagtaggcaattacaatcccaatactgatccaaagaactttaaccttgctgatcctgttgaaagaaacacagttggagtaccagctggagggtggactgctattagattcagagcagataatccaggagtttggttcatgcactgccacttggaggtgcacacaacatgggggctaaagatggcctttttggtggataatggcaaaggtcctaagcaatcagtgatacccccaccaaatgatcttcccaaatgctaatgtgtcaatcatcaattaattatgcaactaatatacagagggaagaccttccaatgcggaaacaaaagaagctttggaggaatacagagaagccaggcaaaagaagagtgagtggaaagaaagggttatttaataagagagtacccccaatgttttttctttgagcaaagtaggaggatttgttcaagcacgtttaataaaatggagcgagcattttggttttcctcttgcaaattctattttttaagactctgtatgtacgaattggagccaactagtgttcgctcttgtttgtttcatgaaattcaaaagggttatttacttcgttagatcattgaacaattcggctcactttagcttttcataaa

SEQ ID NO: 647 - DNA, 2003 bp, Soybean
aaatggattctcattgggttcgaatggtgcttctcattgcttgcattcttccagctttggttgaatgcagagtgaggcactacaaatttcatgtggtgtctaaacaaaccaatagattgtgttcaagcaaatctattgtcaccattaatgggaagttcccaggacccacactttacgctagggaagatgatacagtgctggtcaaagtcattaaccaagtcaaccacaacgttaccatccattggcatggtgtgaggcaattgagaactggttgggctgatggacctgcatatgtcacacagtgcccaattcaaccagggcaaacctatctgtacaatttcaccctcaccgggcaaagaggaacacttctttatcatgcacatgttaactggctaaggtcaactctccatggtgccttagttatcttgccaaagagaggtgtgccttatcccttcccaaagccagatgatgaattggttgtggtattaggagaatggtggaaatccgatactgaagctattatcaatgaagctctcaaatcaggattggcaccaaatgtctcagatgctcatactattaatggccttccaggggcagttaccaattgttctacacaagatgtttacaacctacccgtggagagtggaaagacctacctgttgagaattatcaatgctgcactcaatgaagagctcttcttcaaaattgctggccacaagctcacagtggtagaagttgatgccacatatgtaaagcccttcaagattgaaacaattttgatagcccctggtcaaaccaccaatgttcttttaaatgctgaccaaaaatttggcaagtacttggtagcagcttctcctttcatggatgctcctattgctgtggacaacttgactgccacagcaacattgcactacacaggaactcttgctgccactcccacaattctcaccaccccacctcccaaaaattctacacaaattgccaacaacttcatctcctctcttagaggccttaactccaagaaataccctgtcaatgtcccattaactgttgatcactcacttttcttcactgttgggttggggattagcccttgtccatcttgcaaagctgcaaatggaagcagggttgtggctgctatcaacaatgtgacatttattatgccaaccattgccttacttcaagcacattatttcaacataaaaggggtgttcaccactgatttccctgccaatccaccccatttgttcaactactcaggtcctggaccagccaatttgaacaccgaaactggcacaaaggtttatcgggtaccattcaatgccacagttcaggttgtgctgcaagatactggaatcattgcacctgagaaccacccagttcatcttcatgggttcaatttctttgttgttggaagaggagtaggaaatttcaaccccaaaattgaccctaagaactttaaccttgttgatcctgttgaaaggaacactattggagtaccagctggagggtggactgcatttagatttagagcagataatccaggagtttggttcatgcactgccacttggaggtacacacaacatgggggctaaagatggcctttttggtggacaatggcaaaggtccaaagcaatcagtgataccaccacctaaagatcttcccaaatgctaatgcgtcaatcatcaattaattatgcaatacacaaaagaaaggccttccaatgccgaaacaaaagaagctttggagggatacagagaagccaggcaaaagaagagtgagtgaaaagaaaaaggttatttaataagcgagtatccccgaatatttttctttgagcaaataggtgatttgttcaaccacgtttaataagatggagcgagcattttggttttcctcttgcaaattcatttttctaagacgcattgtgtatgtatcggaatcaacaagtgtacactcttgtttgtttcatggaatacagaaaggttatttacttcgataaat

SEQ ID NO: 648 - DNA, 2416 bp, Soybean
gaatgcaacacacaaggacacaagaagtacgacaaattaagacagggcctaagagaaggtgttgtagagaggatacagcgagagcaaaatgtattctcattgggttcgattgatgcttctcattgcttgcattcttccagctttggttgaatgcagagagaggcactacaaatttcatgtggtgtctaaacaaactaatagattgtgttcaagcaaatctattgtcaccattaatggcaagttcccgggacccactctttacgccagggaagacgatacagtgttggtcaaagtcatcaaccaagtcaatcacaacgttaccatccattggcatggtgtgaggcaattgagaactggttgggctgatggacctgcatatgtcacacagtgcccaattcaaccagggcaaacctatgtatacaatttcacactcacagggcaaagaggaacacttttgtatcatgcacatgttaattggctaaggtcaactctctatggtgccttggttatcttgccaaagagaggtgtgccttatcctttcccaaaaccagatgatgagttggttgtggtattaggagaatggtggaaatctgatacagaagctgtaatcaatgaagcactcaaatcaggattggcaccaaatgtctcagatgctcatactattaatggccttccagggacagttaccaattgttctacacaggatgtttacaacctgcccgtggagagtggaaagacctaccttttgagaattgtcaatgctgcactcaatgaggagctattcttcaaaattgctggccacaagctcactgtggtagaagttgatgccacatatgtaaagccattcaagattgaaacaattgtgatagcccctggccaaaccaccaatgtgcttctaaatgcaaaccaaaaatctggcaagtacttggtagcagcttctccattcatggatgctcctgttgctgtggataacttgactgccacagcaacattgcactacaccggcactcttgctgccacccccacaattctcaccaccccacctcccaaaaatgctacccaaattgccaacaacttcatcagctctcttagaggccttaactccaagaaataccctgtcaatgtcccattaacagttgatcactcacttatcttcactgttgggttgggaattaacccttgtccatcttgcaaagctgcaaatgggagcagggtggtggctgctatcaacaatgttacatttattatgccaaccattgccttacttcaagcacattatttcaacatcaaaggggtgttcaccactgatttccctgccaatccaccccatgttttcaactactcagggcctggaccagccaatttgaacaccgaaaccggcacaaaggtttacaggctaccattcaacgccacagttcaggtggtgctacaagacacaggaatcattgcacctgagaaccacccagttcatcttcatgggttcaatttctttgttgttggaagaggagtaggcaatttcaaccccaaaattgaccctaagaactttaaccttgttgatcctgttgaaaggaacactattggagtaccagctggagggtggactgcatttagattcagagcagataatccaggagtttggttcatgcactgccacttggaggtacacacaacatggggactaaagatggcctttttggtggacaatggcaaaggtcctaagcaatcagtgatacccccaccaaaagatcttcccaaatgctaatgtgtcaatcatcaattaattatgcaatacacaaaagaaaggccttccaatgccaaaacaaaagaagctttggagggatacagagaagccaggcaaaagaaaagtgagtgaagaagaaagggttatttaataagcgagtatcccaaatgttttttctttgagcaaataggagaatttgttcaaccacatttaataaaatggagcgagcattttagttttcctctttgcaaattcaattttttaagacacgttgtgtatgtattggaatcaacaagtgtatgctcttatttgtttcaggaaatacaataagggttatttacttcgttaaatcgttgatcagattggctgattttagcttttcagaagtatttgaacgaggaatatgtcatttttaacaaaagtggggaaaaaaagtagatagtcgtaaacaagatttactatcgatggcatactaaccgatagggtgtaaatgattctgcttggatcaagttgtttatttttttaactcaattcaattaaacttaattaggttggattggattgtgattcttttttttttttaactcaatccattccggtccaactttaattgcattaaatttgattggttataggattgaaccattaaaaaattatcacctttaagtcttggaa

SEQ ID NO: 649 - DNA, 2185 bp, Medicago
cattggtgaatgcaacttaaggacctgaagttgcaaaagaaaattcaagaaattaaaaagctaagatagtgaaaatggtttcttggattcgagtactacttcttatttgttgcatatttccagcgttggtcgagtgcaaagttaggcactacaaatttcatgtggtggccaaaaatacaagtagattatgttcaagcaaagcaattgtcacagttaatgggaagtttccgggacccactctttatgccagggaagatgatacagtgatagtcaaagttcgtaatcaagtcaacaacaatattaccatccattggcatggtattaggcaattgagaacaggttgggctgatggacctgcatatatcacacaatgtccaattcaacctggacatagttatacatacaatttcaccattactggtcaaagaggaacacttctttggcatgcacatgttaattggctaagatcaactgtccatggtgccattgttattttaccaaagaaaggtgttccttatcctttcccaaagccagatgatgaattggttttggtattaggagagtggtggaaatctgatactgaagctgttatcaatgaagctctaaaatcaggattggcaccaaatgtttcagatgctcataccataaatggtcttcctgggacagtggccaattgttctacacaagatgtttacaaactacctgtggagagtggcaaaacctatctactaagaatcatcaatgctgcactcaatgaagaacttttcttcaaaatagctggccacaaactcacagtagtagaagttgatgcaacatacacaaaaccattccaaattgaaacaattgtgatagcacctggtcaaacaacaaatgtactattaaaagcaaaccaaaaatctggcaaatatttagtagcagcttcacctttcatggatgcacctgttgctgtagacaatttaacagccacagctacattacattattcaggaactactcttacaaacacccctacatttctaactacacctccacctacaaatgctacacaaattgctaataactttttaaactcacttaaaggacttaattccaagaaatacccagttaatgttcctttaaaaattgatcattcacttttttttactgttggattaggggttaatccttgtccttcatgtaaagctggaaatggtagtagagttgtagctgctattaataatgttacatttgttatgccaactacagctttactacaagcacattatttcaacattaagaatgtttttactgcagattttccaccaaatccacctcatatttataatttcactggtgctggacctaaaaacttgaacactacaagtggtacaaagttatataagttatcatttaatgatactgttcagcttgttatgcaagatactggaatcattgcacctgagagtcatcctgttcatcttcatggtttcaatttctttgttgttggtagaggagttggaaattatgatagtaaaaatgattcaaagaagtttaaccttgttgatcctgttgaaaggaacactgttggtgtaccagctggtggttgggttgccattagattcagagctgataatccaggagtttggttcatgcattgccatttggaggtgcatacaacatggggtctaaagatggcctttttggtggacaatggcaaaggtcctaaacaatcagtgatagctccacctaaagatcttccaaaatgttgatattcctcacatcaaatcaaatgttcatacaattcacaaagggtagtaggccttccaaattcacaaaagtaggtgtggagggatacagaggagccaggcaaaaataaaagagagtgaaggggaaaaaaggttatttaataagtgaatactaccataaattgttttttgattgagcaaaagggagaatttgttccagcatatttaataaatggagtatgtacattttgattttcatcacacaattttaagagattgtgcatatgtattattggaaccaacaagtgtacacttttgactttggtgtttggtttaatacaaaagggttatctacttcattatgttattgattagtttagctaaatatggtattcaatttttcgttttgtgaggaaatattcacaattgttgagaggaaaaatatacaccctttaatcact

SEQ ID NO: 650 - DNA, 1634 bp, Cowpea
ggatcgaactataaattcacgatttgggtttgtaatcctttcatctacttaatcacaagtgtattgtttttaatacactagatagagagcactattcttctgatcaaatttgtttgttgcagatttgaaattcagctaagatggactctgctctcaggactgttggagtcaagtacgagtgcttgctttttgatatggatgacactctctacccgctgagcataggtctcaatttgttttgtcgcaagaacattcaagagtatatgttagaacacttgcatattgaagaagatgaagtgccaaaaatgtgcttggatttgtatagagaatacggaacaactatggcaggattgaaggtccttggctatgaatttgacaatgacgagtttcatgcttacgttcatggaaggttaccatacgagaaactgaagcctgatccagtattaaggaaccttctactttccatgcctcaacgtaaaataatattcaccaatgcagatcacgcacatgcagttaaagttctcaacagaatgggtttggaagattgttttgagggcatcatatgctttgaaacgcttaatcctcacaaacaaatcaattgcatggatttaccgaatgatgataatgttctcacagatttaacggagaatggatgtttcaattcccagactcatatcctctgtaaaccctctgtggaagcctttgaagctgctattcggattgctaatgtggatccaaagaaaacaattttctttgatgacagtgttagaaatgttgcaagtgcaaaagtagctggacttcacactgttatattgggtcattcagatttggtgcctggtgctgatcatgccctgaatagcattcacaatatcaaagaagcattacctgaaatatgggagattgaagaaggaaaccaacagcaaaagattcaacccccagcagtggaaaccatggtcctagcttgagttttgcttcgatgaaagattttagcacactaatcaagcaatcaagggtttcaacctaagctcgtgtctatctaaatttacaataagtttgaaatctctccatatcatgctgatgcttaactatataaatcttcaagttgggacattgaatggatgagaaacttgaaaatgtatattgcagagctaaaaattggagagaaaaaaatatagtaatctactaaataagtttttcgtcggtctggtaaatggtaatacgagatatgtgtgttgtgtatctctcagaagtcgataattcagacgcatataaacatatcaaatatccatattcttacacccttttcaacttaaaatcttaattcacagttagaaaattgtactgcacttcagtgttaaaatcaagtattttgaataacttgtatgaaactttcttgtctactgtgattcaagtgcctctcaacatccattccatcactgaaatctactgacacaacatggagtttctctaaccatggagtctacaacatacattaacatcgtttacttagtaaggccaaaacataaacaaattttaagtgataatggttgaaatgaaaaacctttggatggcttagataagcaactgggcattaaaaataagtgaatcaacattgccagaattatttgcgtaca

SEQ ID NO: 651 - DNA, 1268 bp, Pigeonpea
aagctgcaggggtattattacaatcaaacactatagttaagggtccagattcgagtggagagtgtccaagtacaaaatcgagatttggttttctgtcagtacttgatcggtatccggtggtgaattaggtgatcgtcagatttcaaattccttcttcaagatggatactgatcacagggctggtggtgtcaaatacgagtgcttgctttttgatatggatgacactctctacccgttaagcttaggtctcaatttgttttgtcgccagaacatacaagagtatatgttagaacacttgcatattgaggaaagtgaagtgccaaagatgtgcctggatttgtatagggaatacgggacaactatggctggattaaagctccttggttatgagtttgacaacgatgagtttcatgcttacgtgcatggaagattaccatacgagaaactgaagcctgatccagtattaaggaatcttctgctttcaatgcctcagcgtaaaataatattcaccaatgcagatcacgcacatgcagttcaagttctcaacagattgggtttggaagattgttttgagggcatcatatgctttgaaacgcttaatcctctcaaacaaatcaatgtaccggataatgatcatgtgcccacagattcaacagatagtggatctttcaattcccactcacaaatcctctgcaaaccatctgtggaagcctttgaagctgctattcggattgctaatgtggatccaaataaaacaattttctttgatgacagtgttagaaatgttgaaagtgcaaaattagctggacttcacactgtcttagtgggccattcagatttggtgcctggtgctgatcatgccctgaatagcattcataatatcaaagaagcattacctgaaatatgggagattgaagaagccaaccagcagcaaaagatgcaacccccggcagttgaaaccatggtccaagcctaagttttggttcgataaaatatttagcaaacttatcaagcaaatcatgagttcgtatctatctaaatttacaataattatgtaattgtctccacaacatggtgatgcttaaatatatatatatatatatatcttgcaattggcatcatgaaatggatgggaaactggtaaatgcaaatcgcagaactagaaatttgggtgagataaaatatctacttaatacttatattagttatataataaaacgggtctttcgtaaaggttggtagtacaaaatatgggtgttgtatctctc

SEQ ID NO: 652 - DNA, 1439 bp, Bean
cattgattatttaacataagtcatgaaatgactaatacttactaacttgctattttcctaacaagcagattccagtggagagtatcgaactataaattcaccatttggcttctgtgttagtaatcctgtgatctacttgatcagtggtgtattatcttctgatcaaatttgattttgaacttcagctaagatggatactgctctcaggaatgctggagtcaagtacgagtgcttgctttttgatatggatgacactctctacccgttgagcataggtctcaatttgttttgtcgcaagaacatacaagagtatatgctagaacacttgcatattgaagaaaatgaagtgccaaaaatgtgcttggatttgtatagagaatacggaacaactatggcaggattgaaggtccttggttatgaatttgacaatgacgagtttcatgcttacgttcatggaaggttaccatacgagaaactgaagcctgatccagtattaaggaaccttctgatttccatgcctcaacgtaaaataatattcaccaatgcagatcacgcacatgcagttaaagttctcaacagaatgggtttggaagattgtttcgagggcatcatatgctttgaaacgcttaatcctcacaaacaatacatggatttaccgaatgataatcatgttctcacggatatagcagagagtggatgtttcaattcccacacacgtatcctctgtaaaccatctgtggaagcctttgaagctgctattcggacttctaatgtggatccaaagaaaacaattttctttgatgacagtgttagaaatgttgcaagtgcaaaagtggctggacttcacactgttatattggggcattcagatttggtgcctggtgctgatcatgccctgaatagcattcacaatatcaaagaagcattacctgaaatatgggagattgaagaaagcaaccagcagcaaaagattcaacccccagcagtggaaaccatggtcctagcttgagttttgcttccatgaaatattttagcacacttatcaagcaaatcaagagttacaataagtttgaaatctctccatagcatggcggtgcttagatatataaatgttcaagttggcattttgaatggatgagaaagtagtaaatgtaaattgcagagccaaaaaatggtgagagaaaaagcatctactcatgcactaaataaggttttccattggtctagtaaatggtaatacaagatatgttgttgtatctctcagaacaatagttcactaaaatgcaccaaccgagagcaatggtaattcagacgcatataaacactgcaaatatccacacccctacacccttttcaactgaaaatattaattgacagtttgaaaattgtactgcatttcagtgttaagataaactatatagtcagttcaccagtagcaa

SEQ ID NO: 653 - DNA, 1260 bp, Lotus
gatgctcaccacctaagaaagaaattgggcgtcacttcgcacattgagcttagtggtgggtcttccttcaactttatatacacgtataaatataagatatcgtgagccacaattatttcgtgtttcagaaggcagaggtttattggagattattaggcagtaaattctagatttcttccctgtgcaagtgcttcctacttgttttgtgaattccgtgatcaccggtttccaagttcaagatggatgctcacaggattgatggagtcaaatacgagtgcttgctttttgatatagatgacactctctacccattgagcttaggtctcaatttggcatgtcgcaagaacatacaagagtatatgttggaacacttgcacattgaagaaagtgaagtgccaaagatgtgcctggatttgtatattgaacatgggacaactatggcaggattgaaggcccttggttatgagtttgacaatgatgagtttcatgcttatgtgcatggaagattaccatacgagaaactgaagccagattcagtgttgaggaaccttcttctttccatgcctcagcgtaaaataatattcacaaactcagatcacaaacatgcagttgaagttctcaacagattgggcttggaagattgttttgaaggcatcatatgctttgaaactcttaatcctcccaacatagatgtatcagatgataatcatgtaacagagagtggacgtttcaactcccacacacaaatcctctgcaaaccttctgtggaagccttcgaagctgcgattcggattgcaaatgtggatcctaagaaaacaattttctttgatgacagtactcgaaatattgcaagtgcaaaggtagctggacttcacactgttatggtgggtcgttcagatttggtccctggtgctaaccatgccctgaacagcattcataatatcagagaagcattacctgaaatatgggaggttgaagaagacagccaacagcaaatgatccaatccttagcagtggaagctatagtccttgcataggttttgcttggataaattatctaagtaaacttatcaagcaaatcaagagtttctacctagcagagttttgtctaagttttcaataactttgcaattgcctccacaacatcatgattttaattgtatgaatgacgcaattggcatcttgaaaaagatgtggaaactagtatatgcaaattgcagaagcatgaaattataagagaaaaagacatttactgtgttt

SEQ ID NO: 654 - DNA, 1716 bp, Soybean
gccacaagaatacttgtggtgcgaagaaagagaaaaggagtatatctccattggtgagtagctataaaatagttgggagtgggtgagagtgattcattctctctaactgagaccatcaagaaattaatggaggcatcacccagtactctggattggagaggcagaccatccaaccctgccaaacacggtggaatgattccggctgcttttgttcttgggttgcaagcatttgagataatggcaatagcggcagtgggaaacaatctgataacttatgtggccaatgacatgcacttccctttgtccaaggctgccaacctagtcactaactttgttgggaccatctttctcctctctctcctcggcggctatctatcagactcttaccttggcagcttctggaccatgctcctctttggtttcgtcgaactttctggtttcatactgctatcagtccaagctcatgttcctcaattgaagccacctccatgcaatgtgaacgatggagaacagtgcgtagaagcaaagggcatgaaggccatgatattctttgtagcactctacttggtggcattagggagtgggtgtgtgaagccaaacatgcttgcttatggaggagaccagttcgagcaaaacgacccaaagcagttaaagaagctctcaacctacttcaatgccgcatattttgcattctctgtgggacaacttgtgagcctaaccattcttgtttgggtgcaaactcattcaggaatggacgttggcttcggggtatccgcagctgtaatggcaatgggattgataagcttgatatgtggcactctatattacagaaacaagcccccacaaggaagtattttaactcccgtggctcaggttcttgtcgctgcattttccaaaagaaaccttccatcttccccatcatccatgatcagagtggaacaagttgagcaagtgaagatattgctatctgttattccgatattctcgtgcaccatcgttttcaacaccatcttagcacaacttcagacattctcagtccaacaagggagagcaatggacacccatctcaccaaatcctttaatatccctcccgcctcccttcagtccattccttacattttgctcatctttttagttcctctctatgacaccttctttgtcccatttgccagaaaattcaccggccatgagtctggaatctcacctttgcgccgaataggctttggtctttttctggctaccttttctatggttgcagctgctctgttggagaaaaagagaagggacgcagctgtgaaccatcacaaagttttgtccatcttttggataaccccacaatacttgatatttggcttgtcagagatgttcacagccattggcctccttgagttcttttataaacagtccttgaaagggatgcaagcattctttacagccatcacatattgctcttactcatttggcttttacttgagcacacttttggtttctttggtcaataagatcacttcaacttcttcttcttcagctgctggctggcttcacaacaacgaccttaaccaggacaggcttgatcttttctattggttactggctgtcttaagcttcctcaacttcctcaactatctcttttgttactgtaaagaattatatcgatcaaaatgtcgtatcgatcgagtagctagcatatataatatattgcagttacaagcttaa

SEQ ID NO: 655 - DNA, 1856 bp, Soybean
gaatttcactgatggagacagacaaaggtgaagctcaggctcaggattggagaggcagaccctccaaccctgccaaacacggtggaatgattcccgctgcttttgttcttgggttgcaagcttttgagataatggcaatagccgcagtggggaacaatctgataacctacgtgacgagtgagatgcacttccctttgtccaaggctgccaacctagtcactaactttgttgggaccatctttctcctcgccctcctcggcggctatctttccgactcttacctcggcagcttctggaccatgctcatctttggtttcgttgaactttccggtttcatattgctttctgtccaagctcatgttcctcagttgaagccacccccatgcaatatcaacgatttaggagaacagtgctcagaagcaaagggcatgaaggccatgatattcttcgtagccctgtacttggtggcattaggtagtggttgtgtcaagccaaacatggttgcttacggaggcgaccaattcgaccaagacaaccccaagcaattaaagaagctctctacctacttcaacgctgcatattttgcattctctttgggagaacttgtgagcctgaccattcttgtttgggtacaaactcattccggaatggatgtgggcttcggggtatccgcggctgtaatggcaatgggattgataagcttgatatgtggcactctatattacaggaacaagcccccacaaggcagtattttaactcccattgctcaagttcttgtggctgcaattttcaaaagaaacctgcttcttccatctaaccctcaaatgcttcatggaacccaaaacaatcttattcatactgataaattcaggttcttggacaaggcttgtatcagagtggaacaagagggaaatcaggaaagcgcgtggagattatgcagtgttgcgcaagttgagcaagtgaagatattgctatcggtcattccgatattctcgtgcaccatcgttttcaacaccatcttagcacaactgcagacattctcagtccaacaagggagagcaatggatacccatctcaccaaatcctttaatatccctcctgcgtcgcttcagtcgattccttacattttgctcatcgttttagtccctctctatgacaccttctttgtcccctttgccagaaagttcaccggccatgagtctggaatcccacctttgcgccgaataggctttggtctttttctagctaccttttccatggttgcagctgctctgttggagaaaaagagaagggacgaagctgtgaatcatgacaaagttttgtccatcttttggataaccccacaatacttgatctttggcttgtcagagatgtttacagccattggccttcttgagttcttctacaaacagtccttgaaagggatgcaagcattcttgacagccatcacatattgctcctactcctttggcttttacttgagcacacttttggtttctttggtcaataagatcacttcaacttcttcttcagctgctggctggcttcacaacaacaaccttaaccaggataggcttgatcttttctattggttactggctgtcttaagcttcctcaacttcctcaactatctcttttggtccagacgctattctcatgctccttccgccctacccccacctaatactaaggaacatcatcacaatattccatagacatctatactcttttcagattattaatttacagttactgtaaagaattatatcaagatgtcgtatcgcccgggatctatcgagtagctagcattatatattgcagttataagcttaatcttaattaattcgcccggtacc

SEQ ID NO: 656 - DNA, 2070 bp, Bean
ggagaatgagaagtagaagaaagtttgggatccggatataggggagccaaggatgtgcgtgtgggtaggttagtggatcgatcttgctttttggatagcaaaagacaacattcctttcaccaacaccactataaaatacctctgcaactcactcacttctagaaaacaacaatggagacaactaaagttagtgagaatgaagatgaacttcatcattctcagccacaatcctccaccctcgattggagaggaagaccctctgatcctgccaaacacggtggagtcctccctgctgcttttattctcgggttgcaagcatttgagataatggcaatagctgcagtgggaaacaatctcataacatatgtcaccaatgacatgcacttctctttgtccaaggctgccaacgtagtcaccaactttgtcgggaccatctttctccttgctctcctcggaggctatctatccgactcctacctcggcagcttctggaccatgctcatctttggttttctagaactttctggtttcatattgctgtcggtccaagctcatgttcctcagttgaagcctgcgccgtgcaatgtgttaactgacggagagcactgcgcagaagcaaagggcttcaaggccgtgatattctttgtggcgctgtacttggtggctttagggagtggctgcgtgaagcccaacatgcttgcctacggaggagaccagttcgagcaagacaacccgaagcagtcaaagaagctctcaacttacttcaatgcagcatattttgcattctctgtgggagaactcgtcagcctaaccattcttgtttgggttcaaactcattctggaatggacgttgggttcggtgtatctgctgctgtaatggcaatgggattgataagcttgatatgtggcactctctattacaggaacaagcccccacaaggcagtattttaacccctattgctcaagtgcttgtggctgcaatttcgaaaagaaacctggttctaccatcaaaccctcaaatgcttcatggaagccaaaacaatactggtcttcttctctctgataaactcgggttcttggacaaggcttgtatcagagtccaagagggggaaaacagaaaggaaagcgcgtggagattatgcagtgttgagcaagttgagcaagtgaagatactgctatcggttattcccattttctcgtgcaccatcgttttcaacacaatcttagcacaactgcagacattctcagtccaacaagggagggccatggacagccatctcacgaaatcctttaatatccctcctgcgtcgcttcagtccattccctacattttgctcatcgttttagtccctctctatgacaccttcttcgtcccgtttgccagaaaaatcacaggtcatgagtctggaatctcacctttgcggcgaataggttttggtctttttctagctaccttttccatggttgcagctgctgtgatggagaaaaagagaagggatgcagctgtgaaccttaaccagaccttgtccattttttggataaccccacaattcttaatatttgggttgtcagagatgttcacagccattggtctccttgagttcttttacaaacagtctttgaaagggatgcaagcattcttgacagccatcacatattgttcctactcatttggcttttattttagcacagttttggtttccttggtgaacaagatcacttcaacatcctcaactggtggttggcttcactacaacaaccttaaccaggacaggcttgatcttttctactggctactcgctgtcttgagtttcctcaacttcctcaactatctattttggtccaaacgctatcatgctccttccccataccaacctaacgccaaggaaatcaacccttatgtaggagatgacaatattccctagcaacttaatttacccttcttttcctatctatatacataaagctatccaaaattctgcatgtatactctcttcaaatttacagttactgtaaagaattatatatgaaaatagtgtcttattgatcacaggcttattattactctt

SEQ ID NO: 657 - DNA, 1995 bp, Pigeonpea
cagggctcaggctgagggagtgagaacacacatacctcaatttcagcaaattaattgccttgagtgagaaagagaaagaatggagattgataaaggtgatcaccaagaccaagaagaatcttcctctctcactctcgactggagaggtagaccttccaaccctgccaaacacggtggaatggtccccgctgctttcgttcttggtttgcaagcatttgagataatggcaatcgccgcagtgggaaacaacctcataacttatgtcaccaatcatatgcacttccctctctccaaggctgccaacgttgtcactaactttgttggcaccatcttcctcctcgccctcctcggcggctatctatcagactccttccttggcagcttctggaccatgctcatctttgccttcgtcgaactttctggtttcatattgctatcggttcaagctcacgttcctcagttgaagccaccgccatgcaatgatggagaacactgcgtagaagcaaagggcttcaaggccatgatattctttgtagcgctatacttggtagcgttggggagtggctgtgtcaagcccaacatggttgcttatggaggagaccaattcgatcaagacaaccccaagcagttaaagaagctctcaacttacttcaatgcagcctattttgcattctctttgggagaacttattagcctaacgattcttgtttgggttcaaactcactccggaatggacgtgggcttcggggtgtccgcagctgtaatggcaatgggattgataagcttgatatgtggcactctatattacaggaacaagccccctcaaggcagtattttaacccccattgctcaagttcttgtggctgcaatttcgaaaagaaagctggtttgtccatctaacccacaaatgctttatggaagccaaaacaatgctgctcttcctcataccgataagctcaggttcttggacaaggcttgcatcagagtccaagaggggactaatacaaaggaaagcccgtggagattatgcagtgttacccaagttgagaaagtgaagatattggtgtcggttatcccaattttctcgtgcaccatcgttttcaacacaatcttagcacaactgcaaacattctcagtccaacaagggagagccatggacactcgtctcaccaaatcctttagcatccctcctgcgtcgcttcagtccattccatacattttgctcatctttttagtccctctctatgacaccttcttcgtcccatttgccagaaaaatcaccggtcacgagtcaggaatctcacccttgcggcgaataggttttggcctctttctagctaccttttctatggttgcagctgctattatggagaaaaagagaagggatgcagctgtgaaccataacgaaactttgtccatcttttggataaccccacaatttttaatctttgggttgtcagagatgtttacagccattggcctccttgagtttttctacaaacagtccttgaagggcatgcaagcattcttcacagctatcacatattgctcctactcatttggcttttatttgagcacagttttggtttccttggtgaataagatcacttcaacttcttcatctggtggttggcttcactacaacaaccttaaccaagacaggcttgatcttttctattggatgctggctgtcttaagcttcttcaacttccttagctatgtcttttgctctacacgttattctcatgctccttcttccctaccccaacctaattccaaggagatcaatccatactcaggagatgacaatattccataggatatatattttcaaattatgtatatctttgcttttcttttactatatataaatatatataaagataccgataattctccttagaaatactcttttcggatctacagttactgtaaagaattgtatgaaaatctcgtattgggtcgcaagcttaatctgatacttcctttccttaa

SEQ ID NO: 658 - DNA, 1580 bp, Soybean
aatggaaagaaaaaaaaaaacacgaatccatttggtttctgtcaaatatgatctgcgactgagacagagacgcacgacgacaaaggcgaacaatcagtacgctaaagctataacgtttcaactttcactttcacacgtcaaagaaagatagccattattaagattttaagcgattctcgttcggctcgggatggctggccgctgaaccggaccggttcggcttggagagatcttgttgggctcggaaacacgcatttgcggcggtgatgagagggagctgctgctgctggaaccgtcggacagagcagcggttccgcctcctcgcgatctccaccgttaaatcactcaagatcaagcttctcctcttttgctgcgtcgccttcacgcttctcgccttttccaccagcgcttcttccttcgtcctatggatcaacaaccaaacgccgccgcctccgccacctcgcttccccgattccgggaaagggtattctatagtaatgaacacatggaagagatatgatcttctaaagcagtccatcaagcattattcatcatgtcctcgacttgaatcagtacatattgtgtggagtgaacctgatcctccatcggatattcttttaaaatttctgcaccacgttgtaaagtccaagtctaaagatggaagatatgtgaaattgaggtttgatatcaacaaggaagacagtttgaacaatagatttaaagaaattaaggatttggagacagatgctgtcttttctattgatgatgatgttatatttccttgctctacggtggaatttgcatttgatgtttggcaaagtgcacctgatacaatggttggatttgtacctcgtgtccattgggtggattcattggaaggtaatgacagcaaatttatatatggcggatggtggtctgtgtggtggacgggtacatatagcatggtgctttccaaggcagcattctttcacaaaaagtatttcaatatctacacaaatgagatgccatcatcaattagagaatatgtaaccaagaacaggaattgtgaagatattgcaatgtctttccttgttgcaaatgctaccggtgcaccccccatatgggttaaaggtaaaatattagagattggatcgactggaatcagtagtttgggaggtcacagtgaaagaagaacagaatgcgtcaacagatttgttgccgcgtatgggcggatgcccttggtatctacttcagttaaggctgttgatagccgcaatatctggttttggtgacgctggaattttgattttccttgcatttctagaaattctactgccgtccttttattagctagttgagttactcaattcacgttagtcacagttgtataatatattggatcttatactccattcatgcgttttgccgctaatcgatcaaattccttaggttgatttcttgtattagatatgtaatgcaaggcagcatcgtgtggtgctttttccccctcaaaatattaagaatttcattgtagaatattattaaagggttattacaccctaagagatgaagctctacctgtgatatagttattatttata

SEQ ID NO: 659 - DNA, 1543 bp, Pigeonpea
aataaggaatcccttcaacagttctaattttcatttctcgcatctattcctgtcaatgtgatctgagacaaacgctaacaagtggtactcttcagcgataactctcactttcacacaacgcaacctatctcgcgattccgtgcgcgctttttctgcttccgaggctccggctcgggatgcctcgccgctgaaccggaccggttcggctcggagagatcttcggctcggaaacacgcattgcggcggtgatgagagggagctgctggaaccgtcggacagagcagcgcttccgccatctcgcgatctccaccgttaaatcagtgaagatcaagattctgctctgttgttgcgtcgccttcacgcttctcgccttctccacaagcgcctcttccttcatcctatggaacaatcaaacgccgcctccacctcgctttctcgattccaggaaagggtactctatagtaatgaacacatggaagagatatgatctcctaaagcagtccatcaagcactattcatcatgtcctcgacttgaatcggtacatattgtgtggagtgaaccggatcctccttcagatgttcttttaaaatatctgcaccacgttgtaaagtccaagtctaaggatggacggcttgtgaaattgaagtttgatatcaacaaggaagacagtttgaacaatagatttaaagaaattaaggatttagagactgatgctgtcttttctattgatgacgatgtcatattcccttgctcttcggtggaatttgcatttgatgtttggcaaagtgcgcctgatacaatggttggatttgtacctcgtgtccactggatggattcactggaaggtaatagcaacaaatttatatatggtggatggtggtctgtgtggtggacgggtacgtatagcatggtgctttccaaggcagctttctttcacaaaaagtatttcaatatctacactaaagagatgccatcttcaattagagaatatgtaaccaagaacaggaattgtgaagatattgcaatgtctttccttgttgcaaatgcaactggtgcaccgccgatatgggttaaaggaaaaatatttgagattggatcaactggaattagtagtttgggaggtcacagtgaaagaagaacagagtgcgtcaacaaatttgctgctgtgtatggggggatgcccttggtatctacttcagttaaggctgttgatagccgcaatatctggttttggtgacgctggaattttgattttctttgcttttttagaaattccactaccgtttattagtagctagttcagttactccattcacgttagtcacagctgtataatattggatcttatacacaattcatgcattttgccgctaattgagcaaattccttaggttgatttcttgtattatttatatgtaatacatggcagcatcctgtggtttttttttttttttttttctctcaaaattattacaaatttgattgtagattaaagggtattacacccttagtggtgaagctttatctgtgatatacttctac

SEQ ID NO: 660 - DNA, 1664 bp, Bean
tctctctctctctctctctttctctctcccgtttctctcattatatctattcagcttcgtctcgtttcatttctggcatcaattcctgtcaatgtgatctgcgactgagacagagacacacaacgacaaggctcaacaatcagtaagctacaacgttaagctttcactttcacacgtcaaagccaacctgagcgcacacacaacacaatccgttcaaatttttttctctctccggatgcctcgccgctgaaccggaccgcttcgcctcggagagatcttcgcctcgcctgcgcgcattccttgcggcggtgatgagagggagctgctgcggttggaaccgtcggacagagcagcggttccgtctactcgcgatctccaccgttaaatcagtcaagatcaagcttctcctctgttgctgcgtcgccctcacgcttctcgccttctccacaagcgcttcttccttcgtcctatggaacaaccagacgcctcttccgcctctcttatccgattccaggagagggtattctatcgtaatgaacacgtggaagagatatgatctgctaaagcagtccatcaagcattattcatcatgtcctcgtcttgaatcagtacatattgtgtggagtgaacccaatcctccttcggatattcttttaaaatttctgcaccacgttgtaaagtccaagcctaaagatggacgacaagtgaaattgaggtttgatatcaacaaggaagacagcttgaacaatagatttaaagaaataaaggatttggagacagatgccgtgttttctattgatgacgatgtcatatttccttgctcttcagtggagtttgcatttgatgtttggcaaagtgcacctgatacgatggttggatttgtacctcgtgtccattggctggattcgttgaaagataatgacgacaaatttagctatggtggatggtggtctgtgtggtggacgggtacatatagcatggtgctctccaaggcagcgttctttcacaaaaagtatttcaatatttatacaaacgagatgccatcgtcaattagagaatatataaccaagaacaggaattgtgaagatattgcaatgtctttccttgttgcaaatgctactggagcaccgcccatatgggttaaaggtaaaatatttgagattggatcgactggaatcagtagtttgggaggtcacagtgaaagaagaacagagtgcgtcaacagatttgctgccgtgtatgggcggatgcccttggtatctacttcagtgaaggccgtcgatagccgtaatatctggttttggtgacgctggaattttgatttctttgcggtttttagaagttccactttcgtccgctagttgctagttgagttgatccattctcgttagtcacagatctgtattatattggatcgtatacataattcatgtgttttgctgctaatgatcaaattccttaggttaatttcttgtattattgccaagtaatacaaggcagcatcctgtggtgcttttttctcaaaatattaagaattttattgtacaacattattaaggttttttacacccggagtggtgaagctctatctgtgatacagattttcacgttatctcatctcctattttgaatttatattaacagtcaattagcccaatagataa

SEQ ID NO: 661 - DNA, 1701 bp, Chickpea
catcatcccaaacaaagtgtaaaataataaaataaaaattacgattccatttcaatcgttactattagcgtgaaagtaaactgcgaatcaaaatagcactcaccgttctcagaaaaacaccatagccaacaacgggatccgatcatcgcaatcatcataatcaagcggcgattaaagtatccacgtggcatgaaaaacctgattcatctttccttataaatcgatgcgttgtggaaacccaaccagtggaaaaacagaaaaataaataaacgagaatgttaaacaattaacaacgttaaagccaaacataacttcaaactctcaatcctaatcctccatttaaattgcttcgtctccaagcctgattccgaagctccggttcgaaatggagttcgagttgttttgaaactgaaccggaccggttctattaagcgagatcacggggtttgggttagaaaattttattgacggcggtgatgagagggagctgttggttgaaccgtcggattgaacagaggtttcgtttacttgcgatctccaccgttaaatcagtgaagatcaagcttcttctttgttgttgtgttgctttaacgcttctcgcgttttccacaagtggttccactttcttattatggaataatcaaacttcttctcttcgtcgtttccctgattcaaggaaaggatattctattgtaatgaacacgtggaagagatacgatctcttaaagcagtccatcaaacattattcatcttgtcctcgacttgaatcagtacatatagtgtggagcgaacccaatcctccttcagaaagtcttctaaaatttctgcaccaagctgtaaagtcgaaggctagagatgggcaatatgtgaagttgaggtttgatattaacaaggaagacagtttgaataatagatttaaagaaattgacgatttggagactgatgctgtcttttccattgacgatgatgtcatatttccttgttcttcggtggaatttgcatttgatgtttggcaaagtgcacctgatgcaatggtgggatttgtacctcgtgtccattgggtggattcattaaatggcaacgacaacgtattcaaatatggtggatggtggtctgtgtggtggacgggtacatatagtatggttctctcaaaggcagcattctttcacaaaaagtatttcattctctacacaaatgagatgccatcatcaattcgagaatatgtaactaagaacaggaattgtgaagatattgcaatgtcttttcttgtcgcaaatgcaactggtgcacctccattatgggttaaaggtaaaatatttgagattggatcaactggaatcagtagtttgggaggtcatagtgagcgaagatcggagtgtgtcaacatatttactgctgtgtatggacggatgcccttggtatatacttcagtaaaggccgttgatagtcgcaatacctggttttggtgattgttagattgtaatattttcattgcattttagaaatttcactgttgtcaattagtattgtagtagctagtttttgagatatcacgttcacgttagtcatagagatgtatgatattgaatcttatacacaattcttgctttttggccctaatttagcaagttccttaggttgatttcttgtaatattgacgtgtaatgtaaggcaacctcctaggtaaaggtgcttcttttt

SEQ ID NO: 662 - DNA, 1678 bp, Medicago
atttatttccattcatattgcgtgcatcaaccaaaatctctgaactccgaaccaaaaacagcaccgttctcacaaaaacaccatagccaacaggatcttcctctgtttcttcattttctgatctaaccaatcaaacgggaataaaaccatccacgtgtcatctatcacctgattcatgtctccttaaccatcgaaaacaaacgaatcctcttccattttcatgatccaagacacgttaaaatcttaaactaatcagaagctccggttcgaaatgaaggttttcttggttcgttactgaaccgaaccggttttggttttttttttatttagattttgttgttattagcggcggtgatgagagggagctgttggttgaaccgtcggattgaacagaggtttcggttacttgcgatctccaccgttaaatcagccaagatcaagcttctgttattttgttgcgtcgcgttaacgcttctcgcgttttcttctactggttcaagtttcttattatggaataatactaatcaaacccctcaaattccgagtttcactgattcaaggaaaggatattctattgtaatgaacacgtggaagagatatgatctcttaaagcagtctatcaaacattattcatcttgtcctcgacttgaatcagtacatattgtgtggagtgaacccaatcctccttcagaaagtcttctaaaatatctgcaccatgttgtaaagtccaagtctagagacggacgatatgtaaagttgaggtttgatatcaacacggaagacagtttgaacaatagatttaaagaaattaaggatttggagactgatgctgtcttttctattgacgatgatgtcatatttccttgctcttcggtggaattcgcatttgatgtttggcaaagtgcacctgatgcaatggtgggatttgtacctcgtgtccattgggtagattcattgaatggcgacagcaacaaatttagatatggtggatggtggtctgtgtggtggacgggtacatatagtatggtgctctccaaggcagcattctttcacaaaaagtatttcagtctctacacaaatgagatgccatcatcaattagagaatttgtaactaagaacaggaattgtgaagatattgcaatgtcttttcttgtcgcgaatgcaaccggtgcacccccgttatgggttaaaggtaaaatatatgagattggatcaactggaattagtagtttgggaggtcatagtgaacggagatcagactgtgtcaacatatttacttctgtgtatgggcggatgcccttagtatatacctcagtgaaagccgttgatagtcgcaatgtctggttttggtgattggtagattgtaattttcgttgcatttttagatattccactgttgtcaattattgtttagtagctagttttttttttactctgtttagttgctagttgagttaccacgttcacgttagtcatttatagctgtatgatattaaattttatacacaattcttgcttttttactctgtttagcaagttccttaggttgatttcttgtaatattgaattgtaatgaaaggcagcatcctctgtaagggtgctttttgtctcagagaataaggatttgattgtagaatattgaaattgaaggatattaaaattttagtaattgtaattt

SEQ ID NO: 663 - DNA, 1507 bp, Peanut
agggggaacaaactcttcccgtcttccggtcttccccgttccactttctccctaaacaccattcacgtcctccttttcttctctggctcggccacggagagaaccagaccggttcggttcgactcgtcagaagggggatccggctttctccgcagttgacaatacgtaacggcctaacggaaaacggaaaaactaaacaaactatttgcttttcttttctcctcgggtgatgagatgagagggaggcactttttctaaccgttggattgagcagagggtccgcctgctcgcgatctcagccgttaaatcgttcaagatcaagctcctcctcttcttctgcgtcgggcttacgctaatcgcgttttccacaagtgcttccagcttcttcctttggaataatcaagcacctgctccctattatggccctgatttcaggaaagggtactcaatagtgatgaacacatggaagagatatgatcttcttaagcagtccatcaagcattactcatcatgtcctcgccttgattcagtgcatattgtgtggagcgaaccagatccgccttcggattctcttctgaaatatctataccacgtggtgaagtccgtgcctaaagatgggcaccaagtcaaattgaagtttgacatcaacaaggaggatagcctgaacaacaggttcaaggaaattaaagatctagagtccgatgctgtcttctcaattgatgatgatgtcatattcccttgctcttctgtggagtttgcatttgatgtttggcaaagtgcacctgatacaatggtggggtttgtacctcgtgtccattgggttgattactcgaaaggtggcggctccaaatttaaatatggtggatggtggtccgtgtggtggacgggtacatacagcatggtgctctccaaggcagcattttttcacaaaaagtacttcattctctacacaaatcaaatgccaacgtcacttaaagaatatataactaagaacaggaactgtgaagatattgcaatgtctttccttgttgcaaacgcaactggtgcaccccccatatgggttaaaggaaagatatttgagattggatcaactggaatcagcagtttgggaggtcacagtgaaaaaagaagtgaatgcgtcaacaggtttgcttctgtgtttggaaggatgccattggtgtctacctcggtgaaggctgttgatagtcgcaatatttggttttggtgaagctagattttcgtgttatagtttttatagaaatttcaatgttagctagttgggttacttgatttcactgtagttacagagctgtataatattgtgaatcttgcacacaattcatgcacttagtaaggatagttagcagattccttagattgatttcttgtattattgtctgtaatacaagcacaacagcatggtgcttttcgttccgaaagcaaaatattatgaatttgattgtaaaatatagaggggtattacacccttagcaaagatacttctctt

SEQ ID NO: 664 - DNA, 1684 bp, Peanut
cacactaacaccgaactcgcttcatccattccgtcatttatttttcttcattattcttttccacttttcctattttaccctgcatccacgccgcaccgtaacatctcccctgtaacggctccaccataaggcacgtgccgcgcgtgcttggagcttcgtccctctcctgcaaacctaatcgaccatggaaggtggcgcgtcgccgagttgccgttgctgaaacggaccgatccgagtcgattcgtagggttcggcgattccattgaatgatgagagggagctggttcttgaagcggcgtccggagcagaggttccggttgctggcggcttccgccgtcaaatctgccaggatcaacctcctcctctgctgttgtattgctttggtgctcatcgtactcgccaccaccatttccaccttcgtcgtgttctctgatttccctccttcgcttcctcgctcccatgcttcgggaaaaggatattctattgtaatgaacacatggaagagatatgatctcctaaagcagtccatcgcacattattcatcctgccctcgacttgaatcggtacatatagtttggagtgaaccggatcctccttcagatgatcttttaaaatttcttcttcatgcaatacagtccaagtctatagataggcgacaagtgaaattgaagattgatatcaacaaggaagatagtctgaataatagatttaaagtaattaaggatttggagacagatgctgtcttttctattgatgatgatgtcatatttccttgctcttcagtggaatttgcatttgatgtttggcaaagtgctccagatacaatggttgggtttgtacctcgggcacattggttggattcatcggaaagtggtggcattaaatttagatatgcggggtggtggtctgtgtggtggacaggtacatatagcatggtactttcaaaggcagctttcttccacaaaaagtatttcagtgtctacacgaatgagatgccagcatcaattagagaatatgtgactcataataggaactgtgaagatattgcaatgtctttcctcgttgcaaatgccactgatgcacccccaatatgggtccaaggtaaaatatttgagattggatccaccgggataagcagcttgggagggcacagtgtaagaagaacagaatgtgtcaatagatttactgctgtatatgggcggatgcccttggtatctacttcagtgaaggctgttgatagccgcaacatctggttttggtgagttactggattttcgattttcttggaatgttagaaattattccaccgtcttacagttagctagtagagtaacccgattcttgatagttaaatagctgtataatatcgaatcttagcagggagagcaaactaagcacattgcttagcttgatttcttgtattattggcttgtaatacaagattaccgagtctatttttgtctcatcatatagatttcgattgtagagttaatattataccctcatccaagaaactccatcctatttttgtgtatctttgtatttaaagacaaatcccagagatggtgagtgtaatttactccatacccttccctgcctcctcctctcgctttcttttgtctgtatctttttgtcatggaataaaaggtgtgatgaaacatagacaaatgaacacgctctatca

SEQ ID NO: 665 - protein, 200 aa, Soybean
MSFIGTQQKCKACEKTVYPVDQLSADGTAYHKACFRCSHCKGTLKLSNYSSMEGVLYCKPHFEQLFKESGSFSKNFQSPAKLADKTTHELTRSPSKAASMFSGTQEKCATCGKTAYPLEKVTVEGQAYHKSCFKCSHGGCPITPSNYAALEGILYCKHHFSQLFKEKGSYNHLTKSASVKRAAAAAATATATTVASVPES

SEQ ID NO: 666 - protein, 194 aa, Bean
MSFIGTQQKCKACEKTVYPVDQLSADGTAYHKACFRCSHCKGTLKLSNYSSMEGVLYCKPHYEQLFKETGTFSKNFQSPAKLADKTTPELTRSPSKAASMFSGTQEKCATCGKTAYPLEKVTVEGQAYHKSCFKCSHGGCPITPSNYAALEGILYCKHHFSQLFKEKGSYNHLTKSASIKRAAAAAAAATVPES

SEQ ID NO: 667 - protein, 193 aa, Cowpea
MSFIGTQQKCKACEKTVYPVDQLSADGTAYHKACFRCSHCKGTLKLSNYSSMEGVLYCKPHYEQLFKETGTFSKNFQSPAKLADKTTPELTRSPSKAASMFSGTQEKCATCGKTAYPLEKVTVEGQAYHKSCFKCSHGGCPITPSNYAALEGILYCKHHFSQLFKEKGSYNHLTKSASIKRAAAAAAATVPES

SEQ ID NO: 668 - protein, 190 aa, Pigeonpea
MSFIGTQQKCKACEKTVYPVDQLSADGTAYHKACFRCSHCKGTLKLSNYSSMEGVLYCKPHYEQLFKETGTFSKNFQSPAKLADKTTPELTRSPSKAASMFSGTQDKCATCGKTAYPLEKVTVEGQAYHKSCFKCSHGGCPITPSNYAALEGILYCKHHFSQLFKEKGSYNHLIKSASIKRAAAASVPES

SEQ ID NO: 669 - protein, 189 aa, Lotus
MSFLGTQQKCKACEKTVYPVDQLSADGTSYHKACFRCSHCKGTLKLSNYSSMEGVLYCKPHYEQLFKETGTFKKNFQSPAKLADKNTPELTRSPSKAAGMFSGTQEKCATCGKTAYPLEKVTVESQAYHKSCFKCSHGGCPITPSNYAALEGILYCKHHFSQLFKEKGSYNHLIKSASIKRAAASVPES

SEQ ID NO: 670 - protein, 189 aa, Chickpea
MSFIGTQQKCKACEKTVYPVDQLSADGTSYHKACFRCSHCKGTLKLSSYSSMEGVLYCKPHYEQLFKETGTFKKNFTSPAKLADKTTPELTRSPSKAASMFSGTQDKCATCGKTAYPLEKVTVESQAYHKSCFKCSHGGCPITPSNYAALEGILYCKHHFSQLFKEKGSYNHLIKSASIKRAATSVPES

SEQ ID NO: 671 - protein, 189 aa, Peanut
MSFIGTQQKCKACEKTVYPVDQLSADGTAYHKACFRCSHCKGTLKLSNYSSMEGVLYCKPHYEQLFKETGSFTKNFQSSAKLADKATPELTRSPSKAASMFSGTQEKCATCGKTAYPLEKVTVEGQAYHKSCFKCSHGGCPITPSNYAALEGILYCKHHFSQLFKEKGSYNHLVKSASIKRAATSVPDS

SEQ ID NO: 672 - protein, 191 aa, Medicago
MSFIGTQQKCKACEKTVYPVDQLSADGTSYHKACFRCSHCKGTLKLSSYSSMEGVLYCKPHFEQLFKEHGNFSKNKNFQSPAKVADGTTPVLTRTPSKAAGMFSGTQEKCATCGKTAYPLEKVTVESQAYHKSCFKCSHGGCPITPSNYAALEGILYCKHHFSQLFKEKGSYNHLIKSASIKRAAASVPES

SEQ ID NO: 673 - protein, 191 aa, Trigonella
MSFIGTQQKCKACEKTVYPVDQLSADGTSYHKACFRCSHCKGTLKLSNYSSMEGVLYCKPHFEQLFKEHGNFSKNKNFQSPAKVADSTTPVLTRTPSKAAGMFSGTQEKCATCGKTAYPLEKVTVESQSYHKSCFKCSHGGCPITPSNYAALEGILYCKHHFSQLFKEKGSYNHLIKSASIKRAAASVPES

SEQ ID NO: 674 - protein, 199 aa, Apple
MSFIGTQQKCKACEKTVYPVEELSADGISYHKSCFKCTHCKGTLKLSNYSSMEGVLYCKPHFEQLFKETGNFNKNFQSPAKSAEKLTPELTRSPSKAASMFSGTQDKCATCGKTAYPLEKVTVESQAYHKSCFKCSHGGCPITPSNYAALEGILYCKHHFSQLFKEKGSYNHLIKSASIKRTAAAAAAATAAVASIPEA

SEQ ID NO: 675 - protein, 192 aa, Prunus
MSFIGTQQKCKACEKTVYPVEELSADGVSYHKACFKCTHCKGTLKLSNYSSMEGVLYCKPHFEQLFKETGNFNKNFQSPAKSAEKLTPELTRSPSKAASMFSGTQEKCATCGKTAYPLEKVTVESQAYHKSCFKCSHGGCPITPSNYAALEGILYCKHHFSQLFKEKGSYNHLIKSASIKRAAAAAASIPEA

SEQ ID NO: 676 - protein, 200 aa, Apple
MSFIGTQQKCKACEKTVYPVEELSADGISYHKSCFKCTHCKGTLKLSNYSSMEGVLYCKPHFEQLFKETGNFNKNFQSPAAKSAEKLTPELTRSPSKAASMFSGTQDKCATCGKTAYPLEKVTVESQAYHKSCFKCSHGGCPITPSNYAALEGILYCKHHFSQLFKEKGSYNHLIKSASIKRTAAAAAAAAATVASIPEA

SEQ ID NO: 677 - protein, 189 aa, Soybean
MSFIGTQQKCEACDKTVYPVDQLSADGTAYHKACFKCSHCKGTLKLSNYSSMEGVLYCKPHYEQLFKETGSFKKNFQSPAKQAVKTTPELTRSPSKAASMFSGTQEKCATCGKTAYPLEKVTVEGQAYHKSCFKCSHGSCPITPSNYAALEGVLYCKHHFSQLFKEKGSYNHLIKSASIKREANSVPQA

SEQ ID NO: 678 - protein, 191 aa, Walnuts
MSFTGTQQKCKVCEKTVYPVEQLSADGVVYHKSCFKCSHCKGTLKLSNYSSMEGVLYCKPHFEQLFKETGNFNKNFQSPAKSAEKLTPELTRSPSKAASMFSGTQEKCATCGKTAYPLEKVTVESQAYHKSCFKCSHGGCPITPSNYAALEGILYCKHHFSQLFKEKGSYNHLIKSASIKRAAAAASIPEA

SEQ ID NO: 679 - protein, 200 aa, Strawberry
MSFIGTQQKCKACQKTVYPVEELSADGISYHKSCFKCTHCKGTLKLSNYSSMEGVLYCKPHFEQLFKETGNFNKNFQSPAKSAEKLTPEMTRSPSKAAGMFSGTQEKCATCGKTAYPLEKVTVESQAYHKSCFKCSHGGCPITPSNYAALEGILYCKHHFSQLFKEKGSYNHLIKSASIKRAAAATATAAAAAVASIPEA

SEQ ID NO: 680 - protein, 189 aa, Chestnut, Oak
MSFTGTQQKCKVCEKTVYPVEQLSADGVVYHKSCFKCSHCKGTLKLSNYSSMEGVLYCKPHFEQLFKETGSFNKNFQSPAKSAEKLSPELTRSPSKAASMFSGTQEKCATCGKTAYPLEKVTVESQAYHKSCFKCSHGGCPITPSNYAALEGILYCKHHFSQLFKEKGSYNHLIKSASMKRAAASTPEA

SEQ ID NO: 681 - protein, 201 aa, Centaurea, Cirsium
MSFTGTQQKCKACGKTVYPVELLSADGIDYHKSCFKCSHCKGTLKLSNYSSMEGVLYCKPHFEQLFKESGNFNKNFQSPAKAADKSSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATAAAASPTTASIPEV

SEQ ID NO: 682 - protein, 199 aa, Ambrosia
MSFIGTQQKCKACGKTVYPVELLSADGIDYHKSCFKCSHCKGTLKLSNYSSMEGVLYCKPHFEQLFKESGNFNKNFTSPAKAADKLSPMLTKSPSKAAGMFSGTQEKCATCGKTAYPLEKVTVENQAYHKSCFKCSHGGCSLSPSNYAALEGILYCKHHFSQLFKEKGSYNHLIESASIKRTAAATAAAATPEAASIPE

SEQ ID NO: 683 - protein, 199 aa, Lettuce
MSFIGTQQKCKACGKTVYPVELLSADGVDYHKSCFRCSHCKGTLKLSNYSSMEGVLYCKPHFDQLFKESGNFNKNFQSPARFAENLTPHLTKSPSKAAGMFSGTQEKCATCGKTAYPLEKVTVENEAYHKSCFKCSHGGCSLSPSNYAALEGILYCKHHFSQLFKEKGSYNHLIKSASVKRSAAATAAAAVAATAVPEA

SEQ ID NO: 684 - protein, 190 aa, Tripterygium
MSFIGTQEKCKACQKTVYPVELLSADGVNYHKSCFKCTHCKGTLKLSNYSSMEGVLYCKPHFEQLFKETGNFNKNFQSPAKSAEKLTPELTRSPSKAASMFSGTQEKCATCNKTAYPLEKVTVEGQSYHKSCFKCSHGGCPISPSNYAALEGILYCKHHFSQLFKEKGSYNHLIKSASIKRAAAASVPEA

SEQ ID NO: 685 - protein, 200 aa, Ambrosia
MSFIGTQQKCKACGKTVYPVELLSADGIDYHKSCFKCSHCKGTLKLSNYSSMEGVLYCKPHFEQLFKESGNFNKNFTSPAKAADKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAAATAAAAATPEAASIPE

SEQ ID NO: 686 - protein, 201 aa, Cirsium
MSFTGTQQKCKACGKTVYPVELLSADGIDYHKSCFKCSHCKGTLKLSNYSSMEGVLYCKPHFEQLFKESGNFNKNFQSPAKTAEKSSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATAAAASPTTASIPEV

SEQ ID NO: 687 - protein, 200 aa, Cynara
MPFTGTQQKCKACGKTVYPVELLSADGIDYHKSCFKCSHCKGTLKLSNYSSMEGVLYCKPHFEQLFKESGNFDKNFQSPAKAAEKSSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATAAAAPTTASIPEV

SEQ ID NO: 688 - protein, 198 aa, Guizotia
MSFIGTQQKCKACGKTVYPVELLSADGIDYHKSCFKCSHCKGTLKLSNYSSMEGVLYCKPHFEQLFKESGNFNKNFTSPAKAAEKLSPMLTKSPSKAAGMFSGTQDKCATCGKTAYPLEKVTVENQAYHKSCFKCSHGGCSLSPSNYAALEGILYCKHHFSQLFKEKGSYNHLIKSASVKRTAATTAAAAAAAASIPE

SEQ ID NO: 689 - protein, 189 aa, Beech
MSFTGTQQKCKVCEKTVYPVEQLSADGVVYHKSCFKCSHCKGTLKLSNYSSMEGVLYCKPHFEQLFKETGSFNKNFQSPAKSAEKLTPEMTRSPSKAASMFSGTQEKCATCGKTAYPLEKVTVESQSYHKSCFKCSHGGCPITPSNYAALEGILYCKHHFSQLFKEKGSYNHLIKSASLKRAAASVPEA

SEQ ID NO: 690 - protein, 189 aa, Gossypium raimondii
MSFTGTQQKCKACEKTVYPVELLSADGIPYHKSCFKCSHCKGTLKLGNYSSMEGVVYCKPHFEQLFKESGNFNKNFQSPAKSAEKLTPELTRSPSKAASMFSGTQEKCATCGKTAYPLEKVTVEGQSYHKSCFKCSHGGCPITPSNYAALEGILYCKHHFSQLFKEKGSYNHLIKSASIKRAAASVPEA

SEQ ID NO: 691 - protein, 190 aa, Tripterygium
MSFIGTQEKCKACQKTVYPVELLSADGVNYHKSCFKCTHCKGTLKLSNYSSMEGVLYCKPHFEQLFKETGNFNKNFQSPAKSAEKLTPELTRSPSKAAGMFSGTQEKCATCNKTAYPLEKVTVEGQSYHKSCFKCSHGGCPISPSNYAALEGILYCKHHFSQLFKEKGSYNHLIKSASIKRAAAASVPEA

SEQ ID NO: 692 - protein, 201 aa, Arnica
MSFTGTQQKCKACGKTVYPVELLSADGIDYHKSCFKCSHCKGTLKLSNYSSMEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRAAATAAAAATATATAASIPE

SEQ ID NO: 693 - protein, 201 aa, Dandelion
MSFMGTQQKCKACGKTVYPVELLSADGIDYHKSCFKCSHCKGTLKLSNYSSMEGVLYCKPHFEQLYKESGNFNKNFQSPAKTVDKSSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATAAAASAAVASIPEA

SEQ ID NO: 694 - protein, 199 aa, Sunflower
MSFIGTQQKCKACGKTVYPVELLSADGIDYHKSCFKCSHCKGTLKLSNYSSMEGVLYCKPHFEQLFKESGNFNKNFTSPAKAAEKLSPMLTKSPSKAAGMFSGTQDKCATCGKTAYPLEKVTVENQAYHKSCFKCSHGGCSLSPSNYAALEGILYCKHHFSQLFKEKGSYNHLIKSASIKRTAAAAAAAATPDAASIPE

SEQ ID NO: 695 - protein, 189 aa, Cotton
MSFTGTQQKCKACQKTVYPVELLSADGIPYHKSCFKCSHCKGTLKLGNYSSMEGVVYCKPHFEQLFKESGNFNKNFQSPAKSAEKLTPELTRSPSKAASMFSGTQEKCATCGKTAYPLEKVTVEGQSYHKSCFKCSHGGCPITPSNYAALEGILYCKHHFSQLFKEKGSYNHLIKSASIKRAAASVPEA

SEQ ID NO: 696 - protein, 189 aa, Cotton
MSFTGTQQKCKACEKTVYPVELLSADGIPYHKSCFKCSHCKGTLKLGNYSSMEGVVYCKPHFEQLFKESGNFNKNFQSPARSAEKLTPELTRSPSKAASMFSGTQEKCATCGKTAYPLEKVTVEGQSYHKSCFKCSHGGCPITPSNYAALEGILYCKHHFSQLFKEKGSYNHLIKSASIKRAAASVPEA

SEQ ID NO: 697 - protein, 189 aa, Grape
MSFIGTQQKCKACLKTVYPVEQLSADGVVYHKSCFKCSHCNGTLKLSNYSSMEGVLYCKPHFEQLFKESGNFNKNFQSPAKSAEKLTPELTRSPSKAASMFSGTQEKCATCGKTAYPLEKVTVESQAYHKSCFKCSHGGCPISPSNYAALEGILYCKHHFAQLFKEKGSYNHLIKSASMKRSAASVPDA

SEQ ID NO: 698 - protein, 189 aa, Kiwi
  misc_feature (183)..(183): Xaa can be any naturally occurring amino acid
  misc_feature (186)..(186): Xaa can be any naturally occurring amino acid
MSFTGTQQKCKACEKTVYPVELLSADGVSYHKSCFKCSHCKGTLKLSNYSSMEGVLYCKPHFEQLFKETGSFNKNFQSPAKSADKLTPELTRSPSKAASMFSGTQEKCATCGKTAYPLEKVTVESQAYHKTCFKCSHGGCSITPSNYAALEGILYCKHHFSQLFKEKGSYNHLLKSASMKRPXASXPEA

SEQ ID NO: 699 - protein, 195 aa, Watermelon
MSFIGTQQKCKACEKTVYPVDQLSADGVAFHKSCFKCSHCKGTLKLSNYSSMEGILYCKPHFEQLFKETGNFSKNFLSPAKSSEKPTPELTRSPSKAASMFSGTQEKCATCGKTAYPLEKVTVESQAYHKSCFKCSHGGCSLSPSNYAALDGILYCKHHFSQLFKEKGSYNHLIKSASMKRQAATSDLDPSKVES

SEQ ID NO: 700 - protein, 197 aa, Artemisia
MNFTGTQQKCKACGKTVYPVELLSADGIDYHKSCFKCSHCKGTLKLSNYSSMEGVLYCKPHFEQLFKESGNFNKNFTSPAKAADSPMLTKSPSKAAGMFSGTQDKCATCGKTAYPLEKVTVENQAYHKSCFKCSHGGCSLSPSNYAALEGILYCKHHFSQLFKEKGSYNHLIKSASIKRNAAATAAAATAAAASIPE

SEQ ID NO: 701 - protein, 200 aa, Lettuce
MSFTGTQQKCKACGKTVYPVELLSADGIDYHKSCFKCSHCKGTLKLSNYSSMEGVLYCKPHFEQLFKESGNFNKNFQSPAKAAEKLSPMLTKSPSKAAGMFSGTQEKCATCGKTAYPLEKVTVENESYHKSCFKCSHGGCSLSPSNYAALEGILYCKHHFSQLFKEKGSYNHLIKSASIKRASAASAAAATAAAASIPEV

SEQ ID NO: 702 - protein, 190 aa, Cacao
MSFTGTQQKCKACEKTVYPVELLSADGVPYHKSCFKCSHCKGTLKLGNYSSMEGVLYCKPHFEQLFKETGNFNKNFQSPAAKSAEKLTPELTRSPSKAASMFSGTQEKCATCGKTAYPLEKVTVEGQSYHKSCFKCSHGGCPISPSNYAALEGILYCKHHFSQLFKEKGSYNHLIKSASIKRAAASVPEA

SEQ ID NO: 703 - protein, 198 aa, Flaveria
MNFTGTQQKCKACGKTVYPVELLSADGVDYHKSCFKCSHCKGTLKLSNYSSMEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAATTAAAAAAAASIPE

SEQ ID NO: 704 - protein, 189 aa, Eucalyptus
MSFTGTQVKCKACEKTVYPVEQLSADGVAYHKSCFKCSHCKGTLKLSSYSSMEGVLYCKPHFEQLFKETGNFNKNFQSPAKSADKLTPELARSPSKAAGMFSGTQDKCATCGKTAYPLEKVTVESQSYHKSCFKCSHGGCPITPSNYAALEGILYCKHHFSQLFKEKGSYNHLIKSASMKRAAASIPEA

SEQ ID NO: 705 - protein, 189 aa, Ipomoea nil
MSFIGTQQKCKACEKTVYPVELLSADGINYHKSCFRCSHCKGTLKLSNYSSMEGVLYCKPHFEQLFKESGNFNKNFQSPAKSADKLTPELTRSPSKAASMFSGTQEKCATCGKTAYPLEKVTVENQSYHKSCFKCSHGGCSLTPSNYAALDGILYCKPHFSQLFKEKGSYNHLIKSASVKRPTTPVPEA

SEQ ID NO: 706 - protein, 194 aa, Lettuce
MSFTGTQQKCKACGKTVYPVELLSADGIDYHKSCFKCSHCKGTLKLSNYSSMEGVLYCKPHFEQLFKESGNFNKNFQSPAKAADKLSPMLTKSPSKAAGMFSGTQEKCATCGKTAYPLEKVTVENESYHKSCFKCSHGGCSLSPSNYAALEGILYCKHHFSQLFKEKGKYNHLIKSASIKRSAAATAAASIPEV

SEQ ID NO: 707 - protein, 198 aa, Tragopogon
MSFTGTQQKCKACGKTVYPVELLSADGVDYHKSCFKCSHCKGTLKLSNYSSMEGVLYCKPHFEQLFKESGNFNKNFQSPAKSAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATAAAAVDSIPEV

SEQ ID NO: 708 - protein, 199 aa, Flaveria
MNFTGTQQKCKACGKTVYPVELLSADGVDYHKSCFKCSHCKGTLKLSNYSSMEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAATTTAAAAAAAASIPE

SEQ ID NO: 709 - protein, 85 aa, Sarracenia
MSFTGTQQKCKACEKTVYPVELLSADGVSYHKSCFKCSHCKGTLKLSITPRWKVFYTASLTLSSSSRRPVVSTRISNHLQSQLKS

SEQ ID NO: 710 - protein, 210 aa, Oil palm
MAFSGTQQKCKACNKTVYLMDQLSADGIAYHKSCFKCNHCKGTLKLSNYSSLEGVLYCKPHFEQLFKETGSFNKSFQSPAKSAEKLTPELTRSPSKAAGMFSGTQEKCATCGKTAYPLEKVTVEGQAYHKSCFKCSHGGCPISPSNYAALEGILYCKHHFSQLFKEKGELQPSHQMCFHQAHSSIHPRSLSSFCLLKWIFTQVCDLIIYF

SEQ ID NO: 711 - protein, 139 aa, Phlya
MEGVLYCKPHYEQLFKETGSFTKNFQSPAKSAEKLTPELTRSPSKAAGMFSGTQDKCATCGKTAYPLEKVTVESQSYHKSCFRCSHGGCSLNPSNYAALDGILYCKPHFSQLFKEKGSYNHLIKSASMKRPTAAAVPDS

SEQ ID NO: 712 - protein, 195 aa, Momordica
MSFIGTQQKCKACEKTVYPVDQLSADGVAFHKSCFKCSHCKGTLKLSNYSSMEGVLYCKPHFEQLFKETGNFSKNFLSPAKSTDKPTPELTRSPSKAASMFSGTQEKCATCGKTAYPLEKVTVESQAYHKSCFKCSHGGCSLSPSNYAALDGILYCKHHFSQLFKEKGSYNHLIKSASMKRQAATSVPDAENVEL

SEQ ID NO: 713 - protein, 189 aa, Papaya
MSFIGTQQKCKACEKTVYPVELLSADGVPYHKSCFKCTHCKGTLKLGNYSSMEGILYCKPHFEQLFKETGSFNKNFQSPVKSAEKLTPELTRSPSKAASMFSGTQEKCATCGKTAYPLEKVTVEGQSYHKSCFKCSHGGCPISPSNYAALEGILYCKHHFSQLFKEKGSYNHLIKSASLKRATASVPDA

SEQ ID NO: 714 - protein, 194 aa, Senecio
MSFTGTQQKCKACGKTVYPVELLSADGVDYHKSCFKCTHCKGTLKLSNYSSMEGVLYCKPHFEQLFKESGNFNKNFTSPAKDADKLSPMLTKSPSKAAGMFSGTQDKCATCGKTAYPLEKVTVENQAYHKSCFKCSHGGCSLSPSNYAALEGILYCKHHFSQLFKEKGSYNHLIKSASIKRNAAATAAAAAAAA

SEQ ID NO: 715 - protein, 200 aa, Flaveria
MNFTGTQQKCKACGKTVYPVELLSADGVDYHKSCFKCSHCKGTLKLSNYSSMEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAASTTAAAAAAAAASIPE

SEQ ID NO: 716 - protein, 199 aa, Centaurea
MSFIGTQQKCKACGKTVYPVELLSADGVDYHKSCFKCTHCKGTLKLSNYSSMEGVLYCKPHFEQLFKESGNFNKNFQSPAKSAEKLTPQLTKSQSKAAGMFSGTQDKCATCGKTAYPLEKVTVENEAYHKSCFKCSHGGCSLSPSNYAALEGILYCKHHFSQLFKEKGSYNHLVLSATIKRTAAAEAAAASAAATVPEV

SEQ ID NO: 717 - protein, 188 aa, Safflower
MSFTGTQQKCKACRKTVYPVELLSADGIDYHKSCFKCSHCKGTLKLSNYSSMEGVLYCKPHFEQLFKESGNFNKNFQSPAKAADKPSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSAAAATA

SEQ ID NO: 718 - protein, 172 aa, Melon
MSFIGTQQKCKACDKTVYPVDQLSADGVSFHKSCFKCSHCKGTLKLSNYSSMDGVLYCKPHFEQLFKETGNFSKNFLSPAKSSEKPTPELTRSPSRAASMFSGTQEKCATCGKTAYPLEKVTVESQAYHKSCFKCSHGGCSLSPSNYAALEGILYCKHHFSQLFKEREATTI

SEQ ID NO: 719 - protein, 192 aa, Avocado
MAFSGTQQKCKVCDKTVYVVDQLMADGAAYHKSCFRCNHCKGTLKLSNYSSLEGVLYCKPHFEQLSKKTGSFNKSFQSPAKSAEKLTPELTRSPSKAASMFSGTQEKCATCGKTAYPLERVTVESQAYHKSCFKCSHGGCPITPSNYAALEGILYCKHHFSQLFKEKGSYNHLIKCASIKRTGATATPVPEL

SEQ ID NO: 720 - protein, 189 aa, Clementine, Orange
MSFIGTQQKCKVCEKTVYPVEQLSADGVVYHKSCFKCSHCKGTLKLSNYSSMEGVLYCKPHFEQLFKESGNFNKNFQSPAKSAEKLTPELTRSPSKAASMFSGTQEKCASCSKTVYPLEKVAVENQAYHKTCFKCSHGGCSISPSNYAALEGILYCKHHFSQLFKEKGSYNHLIKSASMKRAAASVPEA

SEQ ID NO: 721 - protein, 189 aa, Euonymus
MSFIGTQEKCKACQKTVYPVELLSADGVNYHKSCFKCTHCKGTLKLSNYSSMEGVLYCKPHFEQLFKETGNFNKNFQSPAKSAEKLTPELTRSPSKAASMFSGTQEKCATCNKTAYPLEKVTVEGQSYHKSCFKCSHGGCAISPSNYAALEGILYCKHHFSQLFKEKGSYNHLIKSASIKRAAASVPEA

SEQ ID NO: 722 - protein, 189 aa, Nasturtium
MSFLGTQQKCKACVKTVYPVELLSADGVSYHKSCFKCTHCKGTLKLSNYSSMEGVLYCKPHFEQLFKESGSFTKNFQSPAKSADKLTPELTRSPSKAAGMFSGTQEKCATCGKTAYPLEKVTVESQSYHKSCFKCSHGGCALSPSNYAALEGILYCKHHFSQLFKEKGSYNHLIKCASIKRAAASVPEA

SEQ ID NO: 723 - protein, 189 aa, Poplar
MSFTGTQQKCKACEKTVYPMELLSADGVAYHKTCFKCFHCKGTLKLSNYSSMEGVLYCKPHFEQLFKETGNFNKNFQSPAKSAEKLNPELTRSPSKAASMFSGTQEKCATCGKTAYPLEKVTVESQAYHKSCFKCSHGGCAITPSNYAALEGVLYCKHHFSQLFKEKGSYNHLIKSATMKRAAASVPEA

SEQ ID NO: 724 - protein, 201 aa, Flaveria
MNFTGTQQKCKACGKTVYPVELLSADGVDYHKSCFKCSHCKGTLKLSNYSSMEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAATTTAAAAAAAAAASIPE

SEQ ID NO: 725 - protein, 201 aa, Cirsium
MSFIGTQQKCKACGKTVYPVELLSADGVDYHKSCFKCSHCKGTLKLSNYSSMEGVLYCKPHFEQLFKESGNFNKNFQSPAKSAEKLTPQLTKSQSKAAGMFSGTQDKCATCGKTAYPLEKVTVENEAYHKSCFKCSHGGCSLSPSNYAALEGILYCKHHFSQLFKEKGSYNHLIKSATIKRSAAIEAAAAAAAAETTVPEV

SEQ ID NO: 726 - protein, 200 aa, Arabidopsis lyrata
MSFTGTQQKCRACEKTVYPVELLSADGISYHKSCFKCSHCKSRLQLSNYSSMEGVVYCRPHFEQLFKESGSFSKNFQSPAKPLTDKPTPELTRTPSRLAGMFSGTQDKCATCSKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 727 - protein, 200 aa, Arabidopsis
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 728 - protein, 148 aa, Flaveria
MEGVLYCKPHFEQLFKESGNFNKNFTSPAKAAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAATTTAAVAAAAASIPE

SEQ ID NO: 729 - protein, 199 aa, Arabidopsis lyrata
MSFTGTQQKCKACEKTVYAVELLSADGVGYHKSCFKCTHCKSRLQLSSYSSMEGVLYCKPHFEQLFKESGSFNKNFQSPAKPADKSTPELTRTPSRVASRFSGTQEKCATCSKTVYPIEKVTVESQTYHKSCFKCSHGGCPISPSNYAALEGILYCKHHFAQLFKEKGSYNHLIKSASIKRSAAAAVAAGVPAASGPES

SEQ ID NO: 730 - protein, 199 aa, Arabidopsis
MSFTGTQQKCKACEKTVYAVELLSADGVGYHKSCFKCTHCKSRLQLSSYSSMEGVLYCKPHFEQLFKESGSFNKNFQSPAKSADKSTPELTRTPSRVAGRFSGTQEKCATCSKTVYPIEKVTVESQTYHKSCFKCSHGGCPISPSNYAALEGILYCKHHFAQLFKEKGSYNHLIKSASIKRSAAAAVAAGVPAASVPES

SEQ ID NO: 731 - protein, 189 aa, Euphorbia, Spurge
MSFTGTQQKCKACEKTVYPMELLSADGIPYHKSCFKCFHCKGTLKLSSYSSMEGVLYCKPHFEQLFKESGNFNKNFQSPAKSAERLNPEFTRSPSKAAGMFSGTQEKCATCGKTAYPLEKVTVESQAYHKSCFKCSHGGCSLSPSNYAALEGILYCKHHFSQLFKEKGSYNHLIKSASIKRAAASVSES

SEQ ID NO: 732 - protein, 206 aa, Radish
  misc_feature (192)..(192): Xaa can be any naturally occurring amino acid
MSSFTGTQQKCKACEKTVYPVELLSADGVSYHKSCFKCSHCKSRLQLSRYSSMEGVLYCKPHYEQLFKESGSFTKNFQSPAKPAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGXQQQRFLNLKFKNHL

SEQ ID NO: 733 - protein, 189 aa, Cassava
MSFTGTQQKCKACEKTVYPMELLSADGVPYHKSCFKCFHCKGTLKLSNYSSMEGVLYCKPHFEQLFKETGNFNKNFQSPAKSAEKLTPELTRSPSKAASMFSGTQEKCATCGKTAYPLEKVTVESQAYHKSCFKCSHGGCSLSPSNYAALEGVLYCKHHFSQLFKEKGSYNHLIKSASMKRAAASVPEA

SEQ ID NO: 734 - protein, 189 aa, Cassava
MSFTGTQQKCTACEKTVYPMELLSADGVSYHKSCFKCFHCKGTLKLSNYSSMEGVVYCKPHFEQLFKETGNFNKNFQSPAKSAEKLTPELTRSPSKAASMFSGTQEKCATCGKTAYPLEKVTVESQAYHKSCFKCSHGGCSITPSNYAALEGVLYCKHHFSQLFKEKGSYNHLIKSASMKRAAASVPEA

SEQ ID NO: 735 - protein, 189 aa, Castorbean
MSFTGTQQKCKACEKTVYPMELLSADGVPYHKSCFKCFHCKGTLKLSNYSSMEGVVYCKPHFEQLFKETGNFNKNFQSPAKSAEKLTPELTRSPSKAASMFSGTQEKCATCGKTAYPLEKVTVESQAYHKSCFKCSHGGCSISPSNYAALEGVLYCKHHFSQLFKEKGSYNHLIKSASMKRAAASVPEA

SEQ ID NO: 736 - protein, 189 aa, Cotton, Gossypium raimondii
MSFIGTQQKCKACEKTVYPVELLSADGVPYHKSCFKCSHCKGTLKLANYSSMEGVLYCKPHFEQLFKETGNFNKNFQSSAKAAEKLTPELTRSPSKAASMFSGTVEKCATCGKTAYPLEKVTVEGQSYHKSCFKCSHGGCSLSPSNYAALEGILYCKHHFSQLFKEKGSYNHLIKSASIKRTAASVPEA

SEQ ID NO: 737 - protein, 189 aa, Cotton
MSFIGTQQKCKACEKTVYPVELLSADGVPYHKSCFKCSHCKGTLKLANYSSMEGVLYCKPHFEQLFKETGNFNKNFQSSAKAAEKLTPEMTRSPSKAASMFSGTVEKCATCGKTAYPLEKVTVEGQSYHKSCFKCSHGGCSLSPSNYAALEGILYCKHHFSQLFKEKGSYNHLIKSASIKRAAASVPEA

SEQ ID NO: 738 - protein, 189 aa, Cucumber, Melon
MSFIGTQQKCKACEKTVYPVEQLSADGVSYHKSCFKCSHCKGTLKLSNYSSMEGVLYCKPHFEQLFKETGNFNKNFQSPAKSAEKLTPELTRSPSKAAGMFSGTQDKCATCGKTVYPLEKVTVESQSYHKSCFKCSHGGCALSPSNYAALEGILYCKHHFSQLFKEKGSYNHLIKSASMKRSAAPVPEA

SEQ ID NO: 739 - protein, 189 aa, Cucurbita
MSFIGTQQKCKACEKTVYPVEQLSVDGVSYHKSCFKCTHCKGTLKLSNYSSMEGVLYCKPHFEQLFKESGNFNKNFQSPAKSAEKLTPELTRSPSKAAGMFSGTQDKCATCGKTVYPLEKVTVESQSYHKSCFKCSHGGCSISPSNYAALEGILYCKHHFSQLFKEKGSYNHLIKSASMKRPAASVPEA

SEQ ID NO: 740 - protein, 189 aa, Watermelon
MSFIGTQQKCKACEKTVYPVEQLSADGVSYHKSCFKCSHCKGTLKLSNYCSMEGVLYCKPHFEQLFKETGNFQKNFQSPAKSAEKLTPELTRSPSKAAGMFSGTQDKCATCGKTVYPLEKVTVESQSYHKSCFKCSHGGCAISPSNYAALEGILYCKHHFSQLFKEKGSYNHLIKSASMKRSAAPVPEA

SEQ ID NO: 741 - protein, 195 aa, Cannabis
MSFLGTQQKCKACDKTVYPVEQLSADGVSYHKSCFKCTGCKGTLKLSNYSSMEGVLYCKPHFEQLFKETGNFNKNFQSPAKSAEKLTPELTRSPSKAASMFSGTQEKCATCGKTAYPLEKVTVESLSYHKSCFKCSHGGCALSPSNYAALEGILYCKHHFSQLFKEKGNYNHLIKSASIKRAAAAASVPEAEAEA

SEQ ID NO: 742 - protein, 200 aa, B. juncea
MSSFTGTQQKCKACEKTVYPVELLSADGVSYHKSCFKCSHCKSRLQLSRYSSMEGVLYCKPHYEQLFKESGSFNKNFQSPAKPAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPATAVPES

SEQ ID NO: 743 - protein, 200 aa, Radish
MSSFTGTQQKCKACEKTVYPVELLSADGVSYHKSCFKCSHCKSRLQLSRYSSMEGVLYCKPHYEQLFKESGSFTKNFQSPAKPAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPATAVPES

SEQ ID NO: 744 - protein, 190 aa, Sarracenia
MAFTGTQQKCKACEKTVYPVELLSADGVSYHKSCFRCSHCKGTLKLSNYSSMEGVLYCKPHFEQLFKETGSFNKNFQSPAAKLPEKSTPVLTRSPSKAATMFSGTQEKCATCGKTAYPLEKVTVESQAYHKSCFKCSHGGCALSPSNYAALEGILYCKHHFSQLFKEKGSYNHLIKSASMKRPTASIPEA

SEQ ID NO: 745 - protein, 188 aa, Gossypium raimondii
MSFIGTQQKCKACEKTVYPVELVSVDGVPFHKSCFKCSHCKGTLKWGNYSSMEGVLYCKPHFEQLFKEAGNYNKNFQSPAKSAEKLTQLTRSPSKAAGMFSGTQDKCATCGKTAYPLEKVTVEGQSYHKSCFKCSHGGCPISPSNYAALEGILYCKHHFSQLFKEKGSYNHLIKSASIKRTAASVPEA

SEQ ID NO: 746 - protein, 83 aa, Heritiera
MFSGTQEKCATCGKTAYPLEKVTVEGQSYHKSCFKCSHGGCPISPSNYAALEGILYCKHHFSQLFKEKGSYNHLIKSASIKRT

SEQ ID NO: 747 - protein, 189 aa, Momordica
MSFTGTLIKCKACEKTVYPVEQLSADGVIYHKSCFKCTHCKGTLKLSNYSSMEGVLYCKPHFEQLFKETGNFNKNFQSPAKSADKLTPELTRSPSKAAGMFSGTQDKCTTCGKTVYPLEKVTVESQCFHKCCFKCSHGGCAISPSNYAALEGILYCKHHFSQLFKEKGSYNHLIKSASMKRTAASVPEA

SEQ ID NO: 748 - protein, 189 aa, Petunia
MSFTGTQQKCKACEKTVYPVELLSADGISYHKSCFKCTHCKGTLKLSSYSSMEGVLYCKPHFEQLYKESGNFNKNFQSPAKSAEKLTPELTRSPSKAASMFSGTQEKCATCGKTAYPLEKVTVENQSYHKSCFKCSHGGCSLNPSNYAALNGILYCKPHFSQLFKEKGSYNHLIKSASMKRPAATVPDS

SEQ ID NO: 749 - protein, 190 aa, Cichorium
MSFTGTQQKCKACGKTVYPVELLSADGIDYHKSCFKCSHCKGTLKLSNYSSMEGVLYCKPHFEQLFKESGNFNKNFQSPAKSAEKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRSTPESIPEV

SEQ ID NO: 750 - protein, 196 aa, Cleome gynandra
MSFTGTQQKCKTCEKTVYPVELLSADGVGYHKSCFKCTHCKSRLQLSNYSSMEGVLYCKPHFEQLFKETGSFNKNFQSPAKPAEKPTPELTRTPSKVASMFSGTQDKCATCSKTVYPLEKVTVESQSYHKSCFKCSHGGCPISPSNYAALEGILYCKHHFAQLFKEKGSYNHLIKSASIKRTAAAAGVAATTVPES

SEQ ID NO: 751 - protein, 189 aa, Hevea
MSFTGTQQKCKACEKTVYPMELLSADGVPYHKSCFKCFHCKGTLKLSNYSSMEGVLYCKPHFEQLFKETGNFNKNFQSPAKSAEKLTPELTRSPSKAASMFSGTQEKCATCGKTAYPLEKVTVESQAYHKSCFKCSHGGCSLSPSNYAALEGVLYCKHHFSQLFKEKGSYNHLIKCASMKRAAASVPEA

SEQ ID NO: 752 - protein, 189 aa, Poplar
MSFTGTQQKCKACEKTVYPMELLSTDGVAYHKSCFKCFHCKGTLKLSNYSSMEGVLYCKPHFDQLFKETGNFNKNFQSPAKSAEKLTPELTRSPSKAAGMFSGTQEKCATCGKTAYPLEKVTVESQAYHKSCFKCSHGGCAITPSNYAALEGVLYCKHHFSQLFKEKGSYNHLIKCASMKRAAAPVPEA

SEQ ID NO: 753 - protein, 206 aa, Rose
DIRQLCFHWHPAECKACAKTVYPVEELSADGISYHKSCFKCTHCKGTLKLSNYSSMEGVLYCKPHFEQLFKETGNFNKNFQSPAKSAEKLTPELTRSPSKAAGMFSGTQEKCATCGKTAYPLEKVTVESQAYHKSCFKCSHGGCPITPSNYAALEGILYCKHHFSQLFKEKGSYNHLIKSASIKRAAAATATATAAAAAVASIPEA

SEQ ID NO: 754 - protein, 199 aa, Aquilegia
MSFIGTQEKCKACDKTVYVMDQLSADGVSYHKACFKCSHCKGTLKLSNYSSMEGVLYCRPHFEQLFKESGNFNKNFQSPVAKSVEKLTPQMTRSPSKAAGMFSGTQEKCATCGKTAYPLEKVTVENQAYHKSCFKCSHGGCSLSPSNYAALDGILYCKHHFSQLFKEKGSYNHLIKCASIKRSPGTATAAAAATVPDDA

SEQ ID NO: 755 - protein, 200 aa, B. oleracea
  misc_feature (81)..(81): Xaa can be any naturally occurring amino acid
MSSFTGTQQKCKACEKTVYPVELLSADGVSYHKSCFKCSHCKSRLQLSRYSSMEGVLYCKPHYEQLFKESGSFTKNFQSPXKPAEKSNPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPATAVPES

SEQ ID NO: 756 - protein, 122 aa, Canola
MSSFTGTQQKCKACEKTVYPVELLSADGVSYHKSCFKCSHCKSRLQLSRYSSMEGVLYCKPHYEQLFKESGSFTKNFQSPVKPAAEKSSPELTRTPSRVAGMFSGTQEKAPLAVKLCILSKR

SEQ ID NO: 757 - protein, 200 aa, Radish
MSSFTGTQQKCKACEKTVYPVELLSADGVSYHKSCFKCTHCKSRLQLSRYSSMEGVLYCKPHYEQLFKESGSFTKNFQSPVKPAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPAAAVPES

SEQ ID NO: 758 - protein, 190 aa, Aristolochia
MAFFSGTQQKCKACEKTVYVVDQLSADGVSYHKACFKCNHCKGTLKLSNYSSLEGVLYCKPHFEQLFKETGSFNKSFQSPAKPVEKLTPELTRSPSKAASMFSGTQEKCATCGKTAYPLEKVTVEGQPYHKSCFKCSHGGCPISPSNYAALEGILYCKHHFSQLFKEKGSYNHLIKCASMKRPTTPIPEA

SEQ ID NO: 759 - protein, 196 aa, B. juncea
TGTQQKCKACEKTVYPVELLSADGVSYHKSCFKCSHCKSRLQLSRYSSMEGVLYCKPHYEQLFKESGSFTKNFQSPAKPAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGAPAAAVPES

SEQ ID NO: 760 - protein, 189 aa, Amborella
MAFSGTQQKCKACEKTVYVMDQLSADGVLYHKSCFKCNHCKGTLKLGNYSSMEGVLYCKPHFEQLFKETGSFNKSFQSPAKSVEKLTPELTRSPSKAASMFSGTQDKCATCGKTAYPLEKVTVESQSYHKSCFKCSHGGCPITPSTYAALEGILYCKHHFSQLFKEKGSYNHLIKCATMKRQAAPVPEA

SEQ ID NO: 761 - protein, 185 aa, Cirsium
MSFTGTQQKCKACGKTVYPVELLSADGIDYHKSCFKCSHCKGTLKLSNYSSMEGVLYCKPHFEQLFKESGNFNKNFQSPAKAADKSSPMLTKSPSKAAGMFSGTQEKCATCGKTAYPLEKVTVENQAYHKSCFKCSHGGCSLSPSNYAALEGICTANIISHSYSRRRAATIISSSLHPSSALQQR

SEQ ID NO: 762 - protein, 189 aa, Cotton
MSFIGTQQKCKACEKTVYPVELVSVDGVPFHKSCFKCSHCKGTLKWGNYSSMEGVLYCKPHFEQLFKEAGNYNKNFQSPAKSAEKLTQLTRSPSKAAGMFSGTQDKCATCGKTAYPLEKVTVEGQSYHKSCFKCSHGGCPISPSNYAALEGILYCKHHFSQLFKEKGSYNHLIKSASIKRTATSVPEAS

SEQ ID NO: 763 - protein, 189 aa, Pepper
MSFTGTQQKCKACEKTVYPVELLSADGISYHKSCFKCTHCKGTLKLSNYSSMEGVLYCKPHFEQLYKESGNFNKNFQSPVKSAEKLTPELTRSPSKAAGMFSGTQEKCATCGKTAYPLEKVTVENQSYHKSCFKCSHGGCSLNPSNYAALDGILYCKPHFSQLFKEKGSYNHLIKSASMKRPAATVPDS

SEQ ID NO: 764 - protein, 184 aa, Ambrosia
MSFIGTQQKCKACGKTVYPVELLSADGIDYHKSCFKCSHCKGTLKLSNYSSMEGVLYCKPHFEQLFKESGNFNKNFTSPAKAADKLSPMLTKSPSKAAGMFSGTQEKCATCGKTAYPLEKVTVENQAYHKSCFKCSHGGCSLSPSNYAALEGILYCKHHFSQLFKEKGSYNHLIKSASIKRTAA

SEQ ID NO: 765 - protein, 189 aa, Basilicum
MSFIGTQQKCKACEKTVYPVELLSADGVSYHKSCFKCSHCKGTLKLSSYSSMEGVLYCKPHYEQLFKETGSFSKNFQSPAKSAEKLTPEMTRSPSKAAGMFSGTQDKCATCGKTAYPLEKVTVESQSYHKSCFKCSHGGCSLTPSNYAALDGILYCKPHFSQLFKEKGSYNHLIKSASMKRPTAVVPDS

SEQ ID NO: 766 - protein, 184 aa, Liriodendron
MAFSGTQQKCKACDKTVYVVDQLSADGVAYHKACFKCNHCKGTLKLSNYSSLEGVLYCKPHFEQLFKETGSFNKSFQSPAKSAEKLTPELTRSPSKAAGMFSGTQEKCATCGKTAYPLEKVTVESQAYHKSCFKCSHGGCPISPSNYAALEGILYCKHHFSQLFKEKGSYNHLIKCATIKRTSA

SEQ ID NO: 767 - protein, 201 aa, Canola
MSSFTGTQQKCKACEKTVYPVELLSADGVSYHKSCFKCSHCKSRLQLSRYSSMEGVLYCKPHYEQLFKESGSFTKNFQSPVKPAAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGAPAAAVPES

SEQ ID NO: 768 - protein, 201 aa, Radish
MSSFTGTQQKCKACEKTVYPVELLSADGVSYHKSCFKCTHCKSRLQLSRYSSMEGVLYCKPHYEQLFKESGSFTKNFQSPVKPAAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRFAAAAVAAGTPAAAVPES

SEQ ID NO: 769 - protein, 201 aa, Radish
MSSFTGTQQKCKACEKTVYPVELLSADGVSYHKSCFKCTHCKSRLQLSRYSSMEGVLYCKPHYEQLFKESGSFTKNFQSPVKPAAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPAAAVPES

SEQ ID NO: 770 - protein, 189 aa, Amorphophallus
MAFLGTQQKCKACDKTVYVMDQLTTDGVVYHKSCFKCNHCKGTLKLSNYSSMEGVLYCKPHFEQLFKETGNFNKNFQSPAKAAEKLTPELTRSPSKAASMFSGTQEKCATCGKTAYPLEKVTVEGQAYHKSCFKCSHGGCSITPSNYAALEGILYCKHHFSQLFKEKGSYNHLIKCASVKRPVTPAPDS

SEQ ID NO: 771 - protein, 190 aa, Antirrhinum
MSSFTGTQQKCKACEKTVYPVELLSADGINYHKSCFKCSHCKGTLKLSSYSSMEGVLYCKPHYEQLFKETGSFTKNFQSPAKSAEKLTPELTRSPSKAAGMFSGTQDKCATCGKTAYPLEKVTVENQSYHKSCFKCSHGGCSLTPSNYAALNGVLYCKPHFSQLFKEKGSYNHLNKSSSMKRPTAVVPDS

SEQ ID NO: 772 - protein, 189 aa, Catharanthus
MSFIGTQQKCKACEKTVYPVELLSADGISYHKSCFKCSHCKGTLKLSSYSSMEGVLYCKPHYEQLFKETGSFSKNFQSPAKSAEKLTPELTRSPSKAAGMFSGTQDKCATCGKTAYPLEKVTVESQSYHKSCFKCSHGGCSLSPSNYAALNGVLYCKPHFSQLFKEKGSYTHVLKSASMKRPTTPVPDS

SEQ ID NO: 773 - protein, 168 aa, Cynara
  misc_feature (164)..(164): Xaa can be any naturally occurring amino acid
  misc_feature (167)..(167): Xaa can be any naturally occurring amino acid
MSFIGTQQKCKACGKTVYPVELLSADGVDYHKSCFKCSHCKGTLKLSNYSSMEGVLYCKPHFEQLFKESGNFNKNFQSPAKSAEKLTPQLTKSQSKAAGMFSGTQDKCATCGKTAYPLEKVTVENEAYHKSCFKCSHGGCSLSPSNYAALEGILYCKHHFSQLXKEXG

SEQ ID NO: 774 - protein, 189 aa, Euonymus
MSFIGTQEKCKACQKTVYPVELLSADGVNYHRSCFKCTHCKGTLKLSNYSSMEGVLYCKPHFEQLFKATGNFNKNFQSPAKSAEKLTPELTRSPSKAASMFSGTQEKCATCNKTAYPVEKVTVEGKSYHKSCFKCSHGGCPISPSNYAALEGILYCKHHFSQLFKEKGSYNHLIKSASIRRAAASVPEA

SEQ ID NO: 775 - protein, 189 aa, Orobanche
MSFIGTQQKCKACEKTVYPVELLSADGVSYHKSCFKCSHCRGTLKLSTYSSMEGVLYCKPHYEQLFKETGSFTKNFQSPAKSAEMLTPEFTRSPSKAAGMFSGTQDKCATCGKTAYPLEKVTVESQSYHKSCFKCCHGGCSLSPSNYAALDGILYCKPHFSQLFKEKGSYNHLIKSASVKRPVAVVPDS

SEQ ID NO: 776 - protein, 63 aa, Phlya
MSFTGTQQKCKACEKTVYPVELLSADGVSYHKSCFKCSHCKGTLKLSSYSSMEGVLYCKPHYE

SEQ ID NO: 777 - protein, 189 aa, Tobacco
MSFIGTQQKCKACEKTVYPVELLSADGVNYHKSCFKCSHCKGTLKLSNFSSMEGVLYCKPHFEQLFKESGNFNKNFQSPAKSAEKLTPELTRSPSKAAGMFSGTQEKCATCGKTAYPLEKVTVENQSYHKTCFKCSHGGCSLSPSNYAALNGILYCKPHFSQLFKEKGSYNHLIKSASMKRPAATVPDS

SEQ ID NO: 778 - protein, 189 aa, Triphysaria
MSFIGTQQKCKACEKTVYPVELLSADGVDYHKSCFKCSHCKGTLKLSNYSSMEGVVYCKPHYEQLFKEAGNFTKNFQSPAKSAEKLSPEFTRSPSKAASMFSGTVDKCATCGKTAYPLEKVSVENQSYHKSCFKCSHGGCSLTPSNYAALDGILYCKPHFSQLFKEKGSYNHVLKSASIKRPAAVVPDS

SEQ ID NO: 779 - protein, 189 aa, Vinca
MSFTGTQQKCKACEKTVYPVELLSADGISYHKSCFKCSHCKGTLKLSSYSSMEGVLYCKPHYEQLFKETGSFTKNFQSPAKSAEKLTPELTRSPSKAAGMFSGTQDKCATCGKTAYPLEKVTVENQSYHKTCFKCSHGGCSLSPSNYAALKGVLYCKPHFSQLFKEKGSYTHVLKSASMKRPTTPVPES

SEQ ID NO: 780 - protein, 201 aa, B. rapa
MSSFTGTQQKCKACEKTVYPVELLSADGVSYHKSCFKCSHCKSRLQLSRYSSMEGVLYCKPHYEQLFKESGSFTKNFQSPVKPAAEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKHSAAAAVAAGAPAAAVPES

SEQ ID NO: 781 - protein, 200 aa, Radish
MSSFTGTQQKCKACEKTVYPVELLSADGVSYHKSCFKCTHCKSRLQLSRYSSMEGVLYCKPHYEQLFKESGSFTKNFQSPVKPVEKSSPELTRTPSRVAGMFSGTQEKCATCSKTVYPIEKVTVESQTYHKSCFKCSHGGCPISPSNYAALEGILYCKHHFAQLFKEKGSYNHLIKSASIKRSAAAAVAAGTPAAAAPES

SEQ ID NO: 782 - protein, 174 aa, Radish
MSSFTGTQQKCKACEKTVYPVELLSADGVSYHKSCFKCTHCKSRLQLSRYSSMEGVLYCKPHYEQLFKESGSFTKNFQSPVKPAAEKSSPELTRTPSRVAGMFSGTQEKCATCSKTVYPIEKVTVESQTYHKSCFKCSHGGCPISPSNYAALEGILYCKHHFAQLFKEKEATTT

SEQ ID NO: 783 - protein, 248 aa, Pigeonpea
MATILGKESGLNLKETELCLGLPGGGGVGGGGGGGGGGGSSEVETPRATGKRGFSETVDLKLNLQSKEDLNENLKNVSKEKTLLKDPAKPPAKAQVVGWPPVRSYRKNMMAQKVSTEDVAEKTTSSTASGAFVKVSMDGAPYLRKVDLTMYKSYKDLSDALAKMFSSFTMGNYGAQGMIDFMNESKLMDLLNSSEYVPTYEDKDGDWMLVGDVPWEMFVESCKRLRIMKGSEAIGLAPRAMEKCKSRS

SEQ ID NO: 784 - protein, 244 aa, Bean
MATMLGKEHHLNLKETELCLGLPGAGGGGGSGGGGGSEVETPRATGKRGFSETVDLKLNLQAKEDLNENLKNAPEEKTLLKDPTKQPAKAQVVGWPPVRSYRKNMMTQKVSTEDGAEKTTSSTASGAFVKVSMDGAPYLRKVDLTMYKSYKDLSDALAKMFSSFTMGNYGAQGMIDFMNERKLMDLLNSSEYVPTYEDKDGDWMLVGDVPWEMFVESCKRLRIMKGSEAIGLAPRAMEKCKSRS

SEQ ID NO: 785 - protein, 245 aa, Cowpea
MATMLAKDHALNLKETELCLGLPGAGGGGGGGGGGGGSEVETPRATGKRGFSETVDLKLNLQAKEDLNDNLKNASEEKTLLKDPTKQPAKAQVVGWPPVRSYRKNMMSQKVSSEEGAEKTTSSTGSGAFVKVSMDGAPYLRKVDLTMYKSYKDLSDALAKMFSSFTMGNYGAQGMIDFMNERKLMDLLNSSEYVPTYEDKDGDWMLVGDVPWEMFVESCKRLRIMKGSEAIGLAPRAMEKCKSRS

SEQ ID NO: 786 - protein, 239 aa, Soybean
MTTMLTNEHGLSLNLKETELCLGLPGGGSEVETPRATGKRGFSETVDLKLNLQTKEDLNENLKNVSKEKTLLKDPAKPPAKAQVVGWPPVRSYRKNMMAVQKVSNEEVAEKTTSSTIANSGAFVKVSMDGAPYLRKVDLTMYKSYKDLSDALAKMFSSFTMGNYGAQGMIDFMNESKLMDLLNSSEYVPTYEDKDGDWMLVGDVPWEMFVGSCKRLRIMKGSEAIGLAPRAMEKCKSRS

SEQ ID NO: 787 - protein, 242 aa, Lotus
MATLLGKVQNDLNLKETELCLGLPGGGGGGGGSDQVETPRSNGKRGFSETVDLKLNLQSKEDLNDDVKNVSKEKTLLKDPAKPPAKAQVVGWPPVRSYRKNMMVQKVNNEDQGTEKTTSSTAGGAFVKVSMDGAPYLRKVDLTMYKSYKELSDALAKMFSSFTMGNYGAQGMIDFMNESKLMDLLNSSEYVPTYEDKDGDWMLVGDVPWEMFVGSCKRLRIMKGSEAIGLAPRAMEKCKNRS

SEQ ID NO: 788 - protein, 236 aa, Medicago
MATMGHGLNLKETELCLGLPGGGGGGGGGGSEVETPRASGKRGFSETVDLKLNLQTKEDLNEKSASKEKTLLKDPAKPPAKAQVVGWPPVRSYRKNMMAQKVNNTEDTEKTTSNTTAAAFVKVSMDGAPYLRKVDLTMYKTYKDLSDALAKMFSSFTTGNYGAQGMIDFMNESKLMDLLNSSEYVPTYEDKDGDWMLVGDVPWEMFVGSCKRLRIMKGSEAIGLAPRAMEKCKNRS

SEQ ID NO: 789 - protein, 240 aa, Chickpea
MATLIGKESGLNLKETELCLGLPGGGGSGSEVETQRAAGKRGFSETVDLKLNLQSNKEDLNDNSKNVSKDKTLLKDPAKPPAKAQVVGWPPVRSYRKNMMAQKVNNSDQDGNEKTTSSTTAGTFVKVSMDGAPYLRKVDLTMYNTYKDLSDALAKMFSSFTTGKYGAQGMIDFMNESKLMDLLNSSEYVPTYEDKDGDWMLVGDVPWEMFVESCKRLRIMKGSEAIGLAPRAMEKCKNRS

SEQ ID NO: 790 - protein, 260 aa, Peanut
MATMLAKEHGLNLKETELCLGLPGGGGGGGGDTATAETPRATGKRGFSETVDLKLNLQGNDTNKEDLNENLKNVPKEKTLLKDPAKPPAKAQVVGWPPVRSYRKNMMAQKVSTEENNNGSATTEKTTSSAAAAATTAASTGGSFVKVSMDGAPYLRKVDLTMYKSYQDLSDALAKMFSSFTMGNYGSQGMIDFMNESKLMDLLNSSEYVPTYEDKDGDWMLVGDVPWEMFVGSCKRLRIMKGSEAIGLAPRAMEKCKSRS

SEQ ID NO: 791 - protein, 248 aa, Cacao
MANMLGAERDLNFKETELCLGLPGGGGGGGGGGGNEVETPKTTGKRGFSETVDLKLNLQSKETGMDLNKNIENGSKEKTLLPACTKDPAKPPAKAQVVGWPPVRSYRKNIMANQKNSCEESDKKASSGGAAFVKVSMDGAPYLRKVDLKMYKSYQELSDALAKMFSSFTMGNYGAQGMIDFMNESKLMDLLNSSDYVPTYEDKDGDWMLVGDVPWEMFVDSCKRLRIMKGSEAIGLAPRAMEKCKSRA

SEQ ID NO: 792 - protein, 241 aa, Clover
MATMIGKDNDLSLKTELCLGLPGGGGGGGSEQVETPRASAKRGFSETIDLKLNLQTKEDLNGNIKNASKDKSLLKDPSKPPAKAQVVGWPPVRSYRKNMMAQKVNNISEDGNNEKTTSSTTSGAFVKVSMDGAPYLRKVDLTMYKTYKDLSDALAKMFSSFTTGNYGAQGMIDFMNESKLMDLLNSSEYVPTYEDKDGDWMLVGDVPWEMFVGSCKRLRIMKGSEAIGLAPRAMEKCKNRS

SEQ ID NO: 793 - protein, 595 aa, Soybean
MKRDHKDSCGGGGAAGGTVKGECSSMQSNGKAKMWEEEQQQQQQQQQQQQQQGMDELLAALGYKVRASDMADVAQKLEQLEMVMGCAQEDGISHLASDTVHYDPTDLYSWVQSMLTELNPEPNNNLDPSSFLIDNNNNIINSTAPVFNDDSEYDLRAIPGIAAYPPPLPQDNHLDEIETANNINKRLKPSPAESADSAASEPTRHVVLVDHQEAGVRLVHTLLACAEAVQQENLKLADALVKHVGILAASQAGAMRKVASYFAQALARRIYGIFPEETLDSSFSDVLHMHFYESCPYLKFAHFTANQAILEAFATAGKVHVIDFGLKQGMQWPALMQALALRPGGPPTFRLTGIGPPQPDNTDALQQVGLKLAQLAQIIGVQFEFRGFVCNSLADLDPNMLEIRPGEAVAVNSVFELHRMLARSGSVDKVLDTVKKINPQIVTIVEQEANHNGPGFLDRFTEALHYYSSLFDSLEGSSSSSTGLGSPSQDLLMSELYLGRQICNVVAYEGPDRVERHETLTQWRGRLDSAGFDPVHLGSNAFKQASMLLALFAGGDGYRVEENNGCLMLGWHTRPLIATSAWKLPSSSESSGLTQ

SEQ ID NO: 794 - protein, 563 aa, Pigeonpea
MKRDHEDRGGVSSSMSNSSGKAKMWEEEQQQGGNDELLAALGYKVRSSDMADVAQKLEQLEMVMGSAQEEGISHLASDTVHYDPTDLYSWVQTMLTELNPPPNNLDHLLIQDPILTPSRVFNDDSEYDLRAIPGIAAYPPQNTNNNIEEIEANNHNNNNNKRLKPSPIESTDSVSEPTRPVVLVDSQETGVRLVHTLMACAEAVQQKNLKLAEALVKHVGILAASQAGAMRKVAFYFAQALAHRIYGAFPEEPLDSSFSDLLHMHFYESCPYLKFAHFTANQAILEAFATAGRVHVIDFGLKQGMQWPALMQALALRPGGPPTFRLTGIGPPQPDNTDALQQVGLKLAQLAETIGVRFEFRGFVCNSLADLDPNMLEIRPGEAVAVNSVFELHRMLARPGSVEKVLDTVKKIKPKIITVVEQEANHNGPVFLDRFTEALHYYSSLFDSLEGSSSSTGLGSPSQDHLMSEVYLGRQICNVVAYEGVDRVERHETLTQWRGRLGSGGFDPVHLGSNAFKQASTLLALFAGGDGYRVEENNGCLLLGWHTRPLIATSAWKLPSSES

SEQ ID NO: 795 - protein, 596 aa, Bean
MKRDFQQACAGGPVKGDSSSMPNGKAKMWEEDRHQQGGGMDELLAALGYKVRASDMADVAQKLEQLEMVMGSAQEEGISHLSSYTVHYDPTDLHSWVQSMLSELNPEPTTILDPSSFLIDNPVHSSPILTTTSRVFNDDSEYDLRAIPGIAAYPPQHATNNATTISTTTATSPTTTVATTNTQTVEEIEPGTNKRLKASPIESSESASEPTRPVVLVDSQEAGVRLVHTLMACAEAVQQENLKLADALVKHVGILAASQAGAMRKVATYFAQALARRIYGIFPEETLDSSLSDLLHMHFYESCPYLKFAHFTANQAILEAFATAGRVHVIDFGLKQGMQWPALMQALALRPGGPPTFRLTGIGPPQPDNTDALQQVGWKLAQLAQTIGVQFEFRGFVCSSLADLDPNMLEIRPGEAVAVNSVFELHRMLARPGSVDKVMDTVKNLNPKIVTIVEQEANHNGPVFLDRFTEALHYYSSLFDSLEGSSSSTGLGSPSQDLLMSEVYLGKQICNVVAYEGVERVERHETLSQWRGRMGSAGFDPVHLGSNAFKQASMLLALFAGGDGYRVEENNGCLMLGWHTRPLIATSAWKLPSPES

SEQ ID NO: 796 - protein, 1010 aa, Soybean
LSLYFFSVVGQLPSQDILALLEFKKGIKHDPTGYVLNSWNEESIDFDGCPSSWNGVLCNAGNVAGVVLDNLGLSADPDLSVFSNLTKLLRSLQNLSLAGNNFSGPIPDSISEMASIKSLDLSRNSFSGMLPVTLTKTTSLVSLNLSHNGFTGKVPKGFELIPALEKLDLHGNMLEGNLDVVFMLLSSASYVDLSENMLSSSDSKKKFLPRISESIKHLNLSHNKLTGSLASGAAEPVFENLKVLDLSYNQLDGELPGFDFVYDLEVLRLSNNRFSGFIPNGLLKGDSLVLTELDLSANNLSGPLSIITSTTLHSLNLSSNEFTGDLPLLTGSCAVLDLSNNKLEGNLTRMLKWGNIEFLDLSGNHLTGTIPEETPQFLRLSYLNLSHNSLSSSLPKVLTQYPKLRVLDISFNQLDGLLLANLLTLSTLQELHLENNMISGGIKFSSSADQSDLQILDLSHNQLNGYFPDEFGSLTGLKVLNIAGNNFSGSLPTTIADMSSLDSLDISENHFAGPLPSNIPKGLQNFNASQNDLSGLVPEVLRKFPSSSFFPGNTKLHFPNGPPGSVSSPAKSSKRKHMNTIVKVIIIVSCVVALFILILLAVFIHYIRISRSPQEYDASKDIHRHPQPIISAPVRTTDRGGALVVSAEDLVTSRKESPSEIISSDEKMAAVTGFSPSKQSHFSWSPESGDSLTGENLARLDTRSPDRLIGELHFLDDTITLTPEELSRAPAEVLGRSSHGTSYKATLENGLLLRVKWLREGVAKQRKEFVKEMKKFANIRHPNVVGLRGYYWGPTQHEKLILSDYISPGSLASFLYDRPGRKGPPLTWAQRLKIAVDVARGLNYLHFDRAVPHGNLKATNVLLDTTDMNARVADYCLHRLMTRAGNIEQILDAGVLGYRAPELAASKKPMPSFKSDVYAFGVILLELLTGRCAGDVISSEEGGVDLTDWVRLRVAEGRGSECFDATLMPEMSNPIAEKGMKEVLGIVMRCIRSVSERPGIKTIYEDLSSI

SEQ ID NO: 797 - protein, 1061 aa, Bean
MKLFSLLVLSLYFFSVVGQLPSQDILALLEFKKGVKHDPSGYVLNSWNEESIDFDGCPSSWNGVLCNGGNVAGVVLDNLGLSADTDLSMFSNLTKLVKLSMANNSITGSLHGSIAEFKSLEFLDISNNLFSSSLPLNIGKLSSLQNLSLAGNNFSGPIPDSISEMASIKSLDLSRNSFSGELPVLLTKVTSLVSLNLSHNGFTGKIPKGFEMITVLEKLDLHGNMLEGNLDVEFLLLSSASYVDLSENRLSSSDSKQKFLPRLSESIKHLNLSHNQLTGSLASGVAEPVFENLKVLDLSYNQLDGELPGFDFVYDLQVLRLSNNMFSGFIPNGLLKGDSLVLTELDLSANNLSGPLSIITSTTLHSLNLSSNQFTGELPPLTGSCAVLDLSTNKLEGNLTRMLKWGNIEFLDLSGNHLMGTIPEETPQFLRLNYLNLSHNSLSSSLPKVLTQYPKLRVLDISFNQLDGPLLSGLLTMSTLRELHLENNVISGGINFSSPDQSDLQILDLSHNQLNGYFPDKFGSLTGLKVLNIAGNNFSGSLPTTIADMNSLDSMDISENHFTGPLPDNMPQGLQNFNASENDLSGLVPEVLRKFPSSSFFPGNSKLHFPNGPPGSTASPAESSKRKHLNTIVKVIIIVSCVVALFILILLAVFIHYIRISRSPPEYDTSKDIHRHPQPIISAPVRTTDRGGALVVSAEDLVTTRKESPSEVISSDEKIAAVTGFSPSKQSHFSWSPESGDSFTGENLARLDTRSPDRLIGELHFLDDSITLTPEELSRAPAEVLGRSSHGTSYKATLENGLLLRVKWLREGVAKQRKEFVKETKKFANIRHPNVVGLRGYYWGPTQHEKLILSDYISPGSLASFLYDRPGRKGPPLTWIQRLKIAVDVARGLNYLHFDRAIPHGNLKATNVLLDTTDMNARVADYCLHRLMTQAGTIEQILDAGVLGYRAPELASSKKPMPSFKSDVYAFGVILLELLTGRCAGDVISSEEGGVDLTDWVRVRVAEGRGSECFDATLMPEMSNPIVEKGMKEVLGIAMRCIRSVSERPGIKTIYEDLSSI

SEQ ID NO: 798 - protein, 1045 aa, Pigeonpea
GQLPSQDILALLEFKKGIKHDPTGYVLNSWNEESIDFDGCPSSWNGVLCNGGNVAGVVLDNLGLSADTDLSVFSNLTKLVKLSMANNSISGKLPDNIADFKSLEFLDISNNLFSSSLPLGIGKLGSLQNLSLAGNNFSGPIPDSISQMASIKSLDLSRNSFSGALPASLTEVNSLVSLNLSHNGFTGKIPKGFELIPALEKLDLHGNMLEGNLDVEFMLLSSASYVDLSENMLSSSDSKQKFLPRLSESIKHLNLSHNQLTGSLASGATEPVFENLKVLDLSYNQLDGELPGFDFVYDLEVLRLSNNRFSGFIPTGLLKGDSLVLTELDLSANNLTGSLSIIISTTLRSLNLSSNEFTGELPLLTGTCAVLDLSNNKLEGNLTRILKWGNIEFLDLSGNHLTGAIPEVTPQFLRLNYLNLSHNSLTSSLPKVITQYPKLRVLDISFNQLDGLLRAGLLTMPTMQELHLENNMISGGINLSSSLGQSDLQILDLSHNQLNGYFPDEFGSLTGLKVLNIAGNNFSGSLPTTIADMSSLDSIDISENHFTGPLPNNMPKGIQSFNASQNDLSGVVPEVLRKFPSSSFFPGNTKLHFPNGPPGSTSSPAESSKRRHMNTIVKVIIIVSCVVALFILILLAVFIHYIRISRSPPEYDTGKDVHRRPQPIISAPVRTTDRGGALVVSTEDLVTSHKESPSEIVTPDEKMAAVTGFSPSKQSHFSWSPESGDSFTGENLARLDTRSPDRLIGELHFLDDTITLTPEELSRAPAEVLGRSSHGTSYKATLDNGLLLRVKWLREGVAKQRKEFVKETKKFANIRHPNVVGLRGYYWGPTQHEKLILSDYISPGSLASFLYDRPGRKGPPLTWSQRLKIAVDVARGLNYLHFDRAIPHGNLKATNVLLDTTDMNARVADYCLHRLMTQAGTIEQILDAGVLGYRAPELAASKKPMPSFKSDVYAFGVILLELLTGRCAGDVISSEEGGVDLTDWVRLRVAEGRGSECFDAALMSETGNAVVEKGMKEVLGIAMRCIRSVSERPGIKTIYEDLSSI

SEQ ID NO: 799 - protein, 976 aa, Soybean
QLPSQDILTLLEFKKGIKHDPTGYVLNSWNEESIDFDGCPSSWNGVLCNGGNVAGVVLDNLGLSADTDLSVFTNLTKLVKLSLSNNSISGTLLDSIADFKSLEFLDISYNLFSSSLPLGIGKLGSLQNLSLAGNNFSGPIPDSISEMASIKSLDLSCNAFSGMLPASLTKTISLVSLNLSHNGFNGKIPKGLELIPALEKLDLHGNMLEGNLDVVFMLSSSASYVDLSENMLSSSDSNQKFLPRISESIKHLNLSHNKLTGSLASGAAEPVFENLKVLDLSYNQLDGELPGFDFVYDLEVLKLSNNRFSGFIPNGLLKGDSLVLTELDLSANNLSGPLSIITSTTLHSLNLSSNEFTGDMPLLTGSCAVLDLSNNKLEGNLTRMLKWGNIEFLDLSRNHLTGAIPEETPQFLRLNYLNLSHNSLSSSLPKVLTQYPKLRVLDISFNQLDGLLPANLLTLPTLQELRLENNMISGGIKFSSSPDQSDLQILDLSHNQLNGYFPDEFGSLTGLKVLNIAGNNFSGSLPTTIADMSSLDSLDISENHFTGPLPSNMPKGLQNFNASQNDLSGVVPEVLRKFPSSSFFPGNTKLHFPNGPPGSISSPAESSKRKHMNTIVKVIIIVSCVVALFILILLAVFIHYIRFSPSKQSHFSWSPESGDSLSGENLARLDTRSPDRLVGELHFLDDTITLTPEELSRAPAEVLGRSSHGTSYKATLENGLLLRVKWLREGVAKQRKEFVKETKKFANIRHPNVVGLRGYYWGPTQHEKLILSDYISLGSLASFLYGRKGPPLTWTQRLKIAVDVARGLNYLHFDRAVPHGNLKATNVLLDTTDMNARVADYCLHRLMTQAGTIEQILDAGVLGYCAPELAASKKPMPSFKSDVYAFGVILLELLTGRCAGDVISSEEGGVDLTDWVRLRVAEGRGSECFEATLMPEMSNPVVEKGMKEVLGIAMRCIRSISERPGIKTIYEDLSSI

SEQ ID NO: 800 - protein, 508 aa, Chickpea
MGQLPSQDILALLEFKKCIKHDPTGYVLNSWNEESIDFDGCPSSWNGVLCNGGNVAGVVLDNLGLSADTDLSVFSNLSKLVKLSMANNSISGKLTNNVADFKSLQFLDISNNLFSSSIPSGIGKFDSLQNLSLAGNNFSGPIPNTISEMASIESLDLSRNTLSEALPPSLTKLNSIVSLNLSHNGFTGKIPKGFELISSLEKLDLHSNMLDGPLDVEFMLLSGASYVDLSDNLLVSSDSGKFLPRISESIKYLNLSHNQLTGSLVGGAEQPVFQNLKVLDLSYNQLNGELPGFDFVYDLQVLKLSNNRFSGFIPNGLLKGDSLVLTELDLSANNLSGPLSMITSTTLHSLNLSSNGFTGELPLLTGSCAVLDLSNNKFEGNLTRMLKWGNVEYLDLSRNHLAGNIPEVTPQFLRMNYLNLSHNDLSHDLPRVLTQYPKLRVLDISSNQFKGLLLPDFFTMQTLQELHLEDNLISGSINLSSSLDQSHLQVLDLSHNQLTSFFLMILAH

SEQ ID NO: 801 - protein, 1048 aa, Medicago
MGQLPSQDILALLEFKKCIKHDPTGYVLNSWNEESIDFDGCPSSWNGVLCNGGNVAGVVLDNLGLSADSDLSVFSNLSKLVKLSMSNNSISGKLPNNIADFKSLEFLDISNNLFSSSIPAGIGKFGSLQNLSLAGNNFSGPIPNSISEMASIKSLDLSRNALSGALPSSLPKLNSLVSLNLSYNRLTGKIPKGFELISSLDKLDLHGNMFDGPLDVEFMLLSSASYVDLSDNMLLSSSSGKFLPGISESIKYLNLSHNQLTGILVGGAEQPVFQDLKVLDLSYNQLNGELPGFDFVYDLQILKLSNNRFSGFIPNGLLKGDSLVLTELDLSANNLSGPLSMITSTTLHFLNLSSNGFTGELPLLTGSCAVLDLSNNKFEGNLTRMLKWGNIEYLDLGRNRLAGNVPEVTPQFLRLNYLNLSNNRLSDDLPKVLTQYPKLRVLDISSNQLKGVLLTELFTMPTLQELHLENNLINGGINLSSSLDQSHLQVLDLSHNQLSSFFPDEFGSLTSLRVLNIAGNNFAGSLPTTIADMSSLNSLDISNNRFTGPLPNSMPKGLRDFNASENDLSGVVPEILRNFPSSSFFPGNAKLHFPNSPPGSTVSPTKSSKGKSMSTAVKVIIIVSCVVALFILILLAVFIHYIRMSRSSTSEYDTATGKDTRGRPQPVISGPIRPTERGAPLVVSAEDLVASRKGSPSEIISPDAKTAAVAGFSPSKHSQFSWSPESGDSLTAENLTRLDTRSPDRLIGELHFLDDTISLTPEELSRAPAEVLGRSSHGTSYKATLDNGLLLRVKWLREGVAKQRKEFVKEIRKFANIRHPNVVGLKGYYWGPTQHEKLILSDYISPGSLASFLYDRPGRNGPPLTWAQRLKIAVDVARGLNYLHFDRAVPHGNLKATNVLLDTADMNARVADYCLHRLMTQAGTIEQILDAGVLGYRAPELAASKKPMPSFKSDVYAFGVILLELLTGRCAGDVITGEEGGVDLTDWLRLRVAEGRGSECFDATLMSEMGNPVVEKGMKEVLGIAIRCIRSVSERPGIKTIYEDLSSI

SEQ ID NO: 802 - protein, 510 aa, Soybean
MFIESFKVESPNVKYTETEIQSVYNYETTELVHENKNGTYQWVVKPKTVKYEFKTNTHVPKLGVMLVGWGGNNGSTLTGGVIANREGISWATKDKIQQANYFGSLTQASAIRVGSFQGEEIYAPFKSLLPMVNPDDVVFGGWDISNLNLADAMARAKVFDIDLQKQLRPYMESMVPLPGIYDPDFIAANQGDRANNVIKGTKKEQVQQIIKDIKEFKESTKVDKVVVLWTANTERYSNLVVGLNDTMENLFASLDRNEAEISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIEFKAENEGKFHSFHPVATILSYLTKAPLVPPGTPVVNALSKQRAMLENILRACVGLAPENNMILEYK

SEQ ID NO: 803 - protein, 510 aa, Pigeonpea
MFVESFKVESPNVKYTETEIQSVYNYETTELVHQNKNGAYQWVVKPKTVKYEFKTNTHVPKLGVMLVGWGGNNGSTLTGGVIANREGISWATKDKIQQANYFGSLTQASAIRVGSFQGEEIYAPFKSLLPMVNPDDIVFGGWDISNLNLADAMARAKVFDIDLQKQLRPYMESMVPLPGIYDPDFIAANQGDRANNVIKGTKKEQVQQIIKDIKEFKETSKVDRVVVLWTANTERYSNVVVGLNDTVENLLASLDRNEAEISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIQFKAEDEGKFHSFHPVATILSYLSKAPLVPPGTPVVNALSKQRAMLENIMRACVGLAPENNMILEYK

SEQ ID NO: 804 - protein, 510 aa, Bean
MFIESFKVESPNVKYTESEIESVYNYETTELVHENKNGTYQWVVKPKTVKYEFKTNTRVPKLGVMLVGWGGNNGSTLTGGVIANREGISWATKDKIEKANYFGSLTQASAIRVGSFQGEEIYAPFKSLLPMVNPDDIVFGGWDISNLNLADAMARAKVFDIDLQKQLRPYMESMVPLPGIYDPDFIAANQGDRANNVIKGTKKEQVQQIIKDIKEFKEKSKVDRVVVLWTANTERYSNVAVGLNDTEENLLASLDRNEAEISPSTLFAIACVMENVPFINGSPQNTFVPGLIDLAIRRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIQFKAEDEGKFHSFHPVATILSYLTKAPLVPPGTPVVNALSKQRAMLENIMRACVGLAPENNMILEYK

SEQ ID NO: 805 - protein, 510 aa, Pigeonpea
MFIHNFKVESPNVKYTETEIQSVYNYETTELVHENRNGTYQWIVKPKSVKYEFKTSTHVPKLGVMLVGWGGNNGSTLTGGVIANREGISWATKDKIQQANYFGSLTQASAIRVGSFQGEEIYAPFKSLLPMVNPDDIVFGGWDISDMNLADAMARAKVFDIDLQKQLRPYMESMVPLPGIYDPDFIAANQEDRANNVIKGTKKEQVQQIIKDIKEFKEATKVDKVVVLWTANTERYSNLVVGLNDTMENLLASLDKNEAEISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKSTIVLHNTCEDSLLAAPIILDLVLLAELSTRIQFKAENEGKFHTFHPVATILSYLTKAPLVPPGTPVVNALSKQRAMLENIMRACVGLAPENNMILEYK

SEQ ID NO: 806 - protein, 510 aa, Soybean
MFIENFKVECPNVKYTETEIQSVYNYETTELVHENRNGTYQWIVKPKSVKYEFKTNIHVPKLGVMLVGWGGNNGSTLTGGVIANREGISWATKDKIQQANYFGSLTQASAIRVGSFQGEEIYAPFKSLLPMVNPDDIVFGGWDISNMNLADAMARAKVFDIDLQKQLRPYMESMLPLPGIYDPDFIAANQEERANNVIKGTKQEQVQQIIKDIKAFKEATKVDKVVVLWTANTERYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIQFKAENEGKFHSFHPVATILSYLTKAPLVPPGTPVVNALSKQRAMLENIMRACVGLAPENNMILEYK

SEQ ID NO: 807 - protein, 510 aa, Peanut
MFIESFKVESPNVKYTETEIQSVYNYETTELVHENKNGTYQWVVKPKTVKYEFKTNTHVPKLGVMLVGWGGNNGSTLTGGVIANREGISWATKDKIQQANYFGSLTQASAIRVGSYQGEEIYAPFKSLLPMVNPDEIVFGGWDISNMNLADAMGRAKVFDIDLQKQLRPYMESMVPLPGIYDPDFIAANQEERANNVIKGTKKEQVQQIIKDIKAFKEANKVEKVVVLWTANTERYSNVVVGLNDTMENLLSALDRNESEISPSTLYALACILENVPFINGSPQNTFVPGLIDLSINRNSLIGGDDFKSGQTKMKSVLVDFLVGAGIKPTSIVSYNHLGNNDGMNLSAPQTFRSKEISKSNVVDDMVNSNGILYEPGEHPDHVVVIKYVPYVGDSKRAMDEYTSEIFMGGKNTIVLHNTCEDSLLAAPIILDLVLLAELSTRIQFKAENEGKFHSFHPVATILSYLTKAPLVPPGTPVVNALSKQRAMLENILRACVGLAPENNMILEYK

SEQ ID NO: 808 - protein, 510 aa, Cowpea
MFIENFKVESPNVKYTETEIQSVYNYETTELVHENRNGTYQWIVKPKSVKYEFKTNTHVPKLGVMLVGWGGNNGSTLTGGVIANREGISWATKDKIQQANYFGSLTQASAIRVGSFQGEEIYAPFKSLLPMVNPDDIVFGGWDISDMNLADAMGRAKVFDIDLQKQLRPYMESMVPLPGIYDPDFIAANQEERANNVIKGTKKEQVAQIIKDIKEFKAATKVDRVVVLWTANTERYSNLVVGLNDTTENLLAALDRNEAEISPSTLYAIACVMENVPFINGSPQNTFVPGLIDFAIEKNSLIGGDDFKSGQTKMKSVLVDFLVGAGIKPTSIVSYNHLGNNDGMNLSAPQTFRSKEISKSNVVDDMVNSNALLYEPGEHPDHVVVIKYVPYVGDSKRAMDEYTSEIFMGGKSTIVLHNTCEDSLLAAPIILDLVLLAELSTRIQFKAEKEGKFHSFHPVATILSYLTKAPLVPPGTPVVNALSKQRAMLENILRACVGLAPENNMILEYK

SEQ ID NO: 809 - protein, 510 aa, Lotus
MFIENFKVESPNVKYTETEIQSVYNYETTELVHENRNGSYQWIVKPKSVKYEFKTSTNVPKLGVMLVGWGGNNGSTLTGGVIANKEGISWATKDKIERANYFGSLTQASAIRVGSFQGEEIYAPFKSLLPMVNPDDVVFGGWDISDMNLADAMGRARVFDIDLQKQLRPYMESMVPLPGIYDPDFIAANQGDRANNVIKGTKKEQIQQIIKDIKEFKEASKVDRVVVLWTANTERYSNLVVGLNDTMENLLASVDRNEAEISPSTLYAIACVMENIPFINGSPQNTFVPGLIDLAIKKNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVADSKRAMDEYTSEIFMGGKNTIVLHNTCEDSLLAAPIILDLVLLAELSTRIQFKSEAEDKFHSFHPVATILSYLTKAPLVPPGTPVVNALSKQRAMLENILRACVGLAPENNMILEYK

SEQ ID NO: 810 - protein, 510 aa, Lotus
MFIESFKVESPNVKYTETEIQSVYNYETTELVHENKNNAYQWVVKPKTVKYEFKTKTNVPKLGVMLVGWGGNNGSTLTGGVIANKEGISWATKDKIQQSNYFGSLTQASAIRVGSFQGEEIYAPFKSLLPMVNPDDIVFGGWDISNLNLADAMARARVFDIDLQKQLRPYMESMVPLPGIYNPDFIAANQGERANNVLKGTKKEQVQQIIKDIKEFKEANKVDEIVVLWTANTERYSNVVVGLNDTEENLLASLDRDEAEISPSTLYAIACVMENIPFINGSPQNTFVPGLIDLAIRKNSLIGGDDFKSGQTKMKSVLVDFLVGAGIKPTSIVSYNHLGNNDGMNLSAPQTFRSKEISKSNVVDDMVNSNAILFEPGEHPDHVVVIKYVPYVADSKRAMDEYISEIFMGGKNTIVMHNTCEDSLLAAPIILDLVLLAELSTRIQFKAENESKFHSFHPVATILSYLTKAPLVPPGTPVVNALSKQRAMLENIMRACVGLAPENNMIMEYK

SEQ ID NO: 811 - protein, 510 aa, Peanut
MFIEKFKVESPNVKYSEDEIESVYNYETTELVHENRNGSYQWIVKPKTVKYEFKTNTHVPKLGVMLVGWGGNNGSTLTGGVIANREGISWATKDKIQQANYFGSLTQASAIRVGSYQGEEIYAPFKSLLPMVNPDNIVFGGWDISKMNLADAMARAKVFDIDLQKQLRPYMESMVPLPGIYDQDFIAANQEARADNVIKGTKKEQIQQIIKDIKEFKEQNKVDRVVVLWTANTERYSNVVVGLNDTMENLMASVDKNESEISPSTLFAIACVMENVPFINGSPQNTFVPGLIDLAISRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIQFKSEAEGKFHSFHPVATILSYLTKAPLVPPGTPVVNALSKQRAMLENIMRACVGLAPENNMILEYK

SEQ ID NO: 812 - protein, 510 aa, Tobacco
MFIENFKVESPNVKYTESEIHSVYDYQTTELVHEEKNGTYQWTVKPKTVKYEFKTDVHVPKLGVMLVGWGGNNGSTLTGGVIANREGISWATKDKVQQANYFGSLTQASTIRVGSFNGEEIYAPFKSLLPMVNPDDVVFGGWDISDMNLADAMARAKVFDIDLQKQLRPYMESMVPLPGIYDPDFIAANQGSRANNVIKGTKKEQIDQIIKDIREFKEKNKVDKVVVLWTANTERYSNVVVGLNDTMENLFASVDRNEAEISPSTLYAIACILENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 813 - protein, 510 aa, Bean
MFIENFKVESPNVKYSETEIQSVYNYETTELVHENRNGAYQWIIKPKSVKYEFKTNTHVPKLGVMLVGWGGNNGSTLTGGVIANREGISWATKDKIQQANYFGSLTQASAIRVGSYQGEEIYAPFKSLLPMVNPDDIVFGGWDISNMNLADAMGRAKVFDIDLQKQLRPYMESMVPLPGIYDPDFIAANQEERANNVIKGTKKEQVQQVIKDIKEFKAATKVDKVVVLWTANTERYSNLVVGLNDTTENLLAALDRNEAEISPSTLFAIACVTENVPFINGSPQNTFVPGLIDFAIQKNCLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVADSKRAMDEYTSEIFMGGKNTIVLHNTCEDSLLAAPIILDLVLLAELSTRIQFKAEKEGKFHSFHPVATILSYLTKAPLVPPGTPVVNALSKQRAMLENIMRACVGLAPENNMILEYK

SEQ ID NO: 814 - protein, 510 aa, Chickpea
MFIESFKVESPNVKYTDTEIQSVYSYETTELVHENRNNTYQWVVKPKTIKYEFKTQTHVPKLGVMLVGWGGNNGSTLTGGVIANREGISWATKDKIQQSNYFGSLTQASAIRVGSFQGEEIYAPFKSLLPMVNPEDIVWGGWDINNMNLADAMGRARVFDIDLQKQLRPYMESMVPLPGIYDPDFIAANQGDRANNVINGTKKEQLQQIIKDIKEFKEASKIDKVVVLWTANTERYSNVVVGLNDTMENLLASVDKNEAEISPSTLYALACVLENVPFINGSPQNTFVPGLIDLAIQRNSLIGGDDFKSGQTKMKSVLVDFLVGAGIKPTSIVSYNHLGNNDGMNLSAPQTFRSKEISKSNVVDDMVNSNAILYQPGEHPDHVVVIKYVPYVADSKRAMDEYISEIFMGGKNTIVLHNTCEDSLLAAPIILDLVLLAELSTRIQFKSQHEDKFHSFHPVATILSYLTKAPLVPPGTPVVNALSKQRAMLENILRACVGLAPENNMILEYK

SEQ ID NO: 815 - protein, 510 aa, Medicago
MFIENFKVESPNVKYTETEIQSVYNYETTELVHENRNGTYQWIVKPKTVKYEFKTDIHVPKLGVMLVGWGGNNGSTLTGGVIANREGISWATKDKIQQANYFGSLTQASAIRVGSFQGEEIHAPFKSLLPMVNPDDIVFGGWDISDMNLADAMARARVFDIDLQKQLRPYMESMVPLPGIYDPDFIAANQGERANNVIKGTKREQINQIIKDIKEFKEANKVDRVVVLWTANTERYSNLVVGLNDTMENLFAAVDRNESEISPSTLFAIACVMENVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVNSNAILYAPGEHPDHVVVIKYVPYVGDSKRAMDEYTSEIFMGGKNTIVLHNTCEDSLLAAPIILDLVLLAELSTRIQFKSEAENKFHTFHPVATILSYLTKAPLVPPGTPVVNALSKQRAMLENIMRACVGLAPENNMILEYK

SEQ ID NO: 816 - protein, 510 aa, Sesame
MFIESFKVESPNVKYTEGEIHSVYNYETTELVHESRNGTYQWIVKPKTVKYEFKTDTHVPKLGVMLVGWGGNNGSTLTGGVIANREGISWATKDKVQQANYFGSLTQASSIRVGSFNGEEIYAPFKSLLPMVNPDDVVFGGWDISNMNLADAMGRAKVLDIDLQKQLRPYMEHMVPLPGIYDPDFIAANQGSRANNVIKGTKKEQVQQIIKDMRDFKEQNKVDKVVVLWTANTERYSNVVVGLNDTAESLMASVERNEAEISPSTLYAIACVFENVPFINGSPQNTFVPGLIDLAIQRNSLIGGDDFKSGQTKMKSVLVDFLVGAGIKPTSIVSYNHLGNNDGMNLSAPQTFRSKEISKSNVVDDMVASNGILYEPGEHPDHIVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 817 - protein, 510 aa, Trigonella
MFIENFKVESPNVKYTETEIQSVYNYETTELVHENRNGTYQWIVKPKTVKYEFKTDTHVPKLGVMLVGWGGNNGSTLTGGVIANREGISWATKDKIQQANYFGSLTQASAIRVGSYQGEEIHAPFKSLLPMVNPDDIVFGGWDISDMNLADAMARARVFDIDLQKQLRPYMESMVPLPGIYDPDFIAANQGERANNVIKGTKREQINQVIKDIKEFKEANKVDRVVVLWTANTERYSNLVVGLNDTMENLFAAVDRNESEISPSTLFAIACVMENVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVNSNAILYAPGEHPDHVVVIKYVPYVADSKRAMDEYTSEIFMGGKNTIVLHNTCEDSLLAAPIILDLVLLAELSTRIQFKSEAENKFHTFHPVATILSYLTKAPLVPPGTPVVNALSKQRAMLENIMRACVGLAPENNMILEYK

SEQ ID NO: 818 - protein, 510 aa, Cassava
MFIEKFKVESPNVKYTEDEVHSVYNYETTELVHENRNGTFQWIVKPKTVKYEFKTNTHVPKLGVMLVGWGGNNGSTLTGGVIANREGISWATKDKVQQANYFGSLTQASSIRVGSFNGEEIYAPFKSLLPMVNPDDIVFGGWDISDMNLADAMARAKVFDIDLQKQLRPYMESMVPLPGIYDPDFIAANQDSRANNVIKGTKKEQVQQIVKDIREFKEKNKVDKVVVLWTANTERYSNVVVGLNDTMENLMAALERNEVEISPSTLYALACIFEEVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGQNTIVLHNTCEDSLLAAPIILDLVLLAELSTRIQLKAEEEGKFHSFHPVATILSYLTKAPLVPPGTPVVNALSKQRAMLENILRACVGLAPENNMILEYK

SEQ ID NO: 819 - protein, 510 aa, Cassava
MFIEKFKVESPNVKYTEDEIHSVYSYETTDLVHENRNGTYEWIVKPKTVKYEFKTNTHVPKLGVMLVGWGGNNGSTLTGGVIANRQGISWATKDKVQQANYFGSLTQASSIRVGSFNGEEIYAPFKSLLPMVNPDDIVFGGWDISDMNLADAMARAKVFEIDLQKQLRPYMESMVPLPGIYDPDFIAANQGSRANNVIKGTKKEQVQQIIKDIREFKEKSKVDKVVVLWTANTERYSNVVVGLNDTMENLLASLEKNEAEISPSTLYALACVLEEVPFINGSPQNTFVPGLIDLAIKSNSLIGGDDFKSGQTKMKSVLVDFLVGAGIKPTSIVSYNHLGNNDGLNLSAPQTFRSKEISKSNVVDDMVASNGILYEPGEHPDHVVVIKYVPYVGDSKRAMDEYTSEIFMGGKNTIVLHNTCEDSLLAAPIILDLVLLAELCTRIQLKAEGEGKFHSFHPVATILSYLTKAPLVPPGTPVVNALSKQRAMLENILRACVGLAPENNMILEYK

SEQ ID NO: 820 - protein, 510 aa, Grape
MFIESFKVESPNVKYTENEIHSVYDYETTELVHENRNGTYQWVVKPKTVKYEFRTDAHVPKLGVMLVGWGGNNGSSLTGGVIANREGISWATKDKVQPANYFGSLTQASTIRVGSYNGEEIYAPFKSLLPMVNPDDIVFGGWDISDMNLADAMARAKVLDIDLQKQLRPYMESMVPLPGIYDPDFIAANQCSRANNVIKGTKKEQVQQIIKDIREFKEATKVDKVVVLWTANTERYSNLIVGLNDTIENLLASLDRNEPEISPSTLYALACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENILRACVGLAPENNMILEYK

SEQ ID NO: 821 - protein, 510 aa, Medicago
MFIENFKVESPNVKYTETEIQSVYSYETTELVHENRNNTYEWVVKPKTVKYEFKTQTNVPKLGVMLVGWGGNNGSTLTGGVIANREGISWATKDKIQQANYFGSLTQASAIRVGSFQGEEIHAPFKSLLPMVNPEDIVWGGWDISNLNLADAMGRARVFDIDLQKQLRPYMESMVPLPGIYDPDFIAANQGDRANNIIKGTKKEQLQQVIKDIKEFKETTKVDKVVVLWTANTERYSNIVVGLNDTTENLLASVDKNEAEISPSTLYALACVLENVPFINGSPQNTFVPGLIDLAIKRNSLIGGDDFKSGQTKIKSVLVDFLVGAGIKPTSIVSYNHLGNNDGMNLSAPQTFRSKEISKSNVVDDMVNSNAILYGPGEHPDHVVVIKYVPYVGDSKRAMDEYTSEIFMGGKNTIVMHNTCEDSLLAAPIILDLVLLAELSTRIQFKSEQEDKFHSFHAVATILSYLSKAPLVPPGTPVVNALSKQRSMLENILRACVGLAPENNMILEYK

SEQ ID NO: 822 - protein, 510 aa, Cucumber
MFIESFKVESPNVEYTANEILSVYNYETTELVHELKNGSYQWTVKPKTVKYQFKTQTHVPKLGVMLVGWGGNNGCTLTGGVIANREGISWATKDKVQQANYFGSLTQASSIRVGSYNGEEIYAPFKSLLPMVNPDDIVFGGWDISDMNLADAMARAKVFDIDLQKQLRPYMESMVPLPGIYDPDFIAANQGSRANNVIKGTKREQVQQIISDIKEFKEKSKVDEVVVLWTANTERYSNVVVGLNDTMESLLASLDKNEAEISPSTLYAIACVLENVPFINGSPQNTFVPGLIDLAIRRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 823 - protein, 510 aa, Vinca
MFIESFKVDSANVKYTETEIHSVYNYETTELVHENRDGTYQWIIKPKTVKYEFKTDTRVPKLGVMLVGWGGNNGSTLTAGVIANREGISWATKDKVQRANYFGSLTQASTIRVGSFNGEEIYAPFKSLLPMVNPDDIVFGGWDISNLNLADAMARGKVLDIDLQKQLRPYMESMVPLPGIYEPDFIAANQGSRANNVLKGTKKEQMQQIIKDIKEFKEKNKVDKVVVLWTANTERYSNVIVGLNDTVENLFASLDRNEAEISPSTLYAMACVLENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGRNTIVLHNTCEDSLLAAPIILDLVLLAELSTRIQLKSEAEGKFHSFHPVATILSYLSKAPLVPPGTPVVNALSKQRAMLENIMRACVGLAPENNMILEYK

SEQ ID NO: 824 - protein, 510 aa, Watermelon
MFIESFKVESPNVKYTANEIHSVYNYETTELVHELKNGSYQWTVKPKTVKYEFNTQTHVPKLGVMLVGWGGNNGSTLTGGVIANREGISWATKDKVQQANYFGSLTQASSIRVGSYNGEEIYAPFKSLLPMVNPDDIVFGGWDISDMNLADAMARAKVFDIDLQKQLRPYMESMVPLPGIYDPDFIAANQGSRANNVIKGTKREQVQQVINDIKEFKEKNKVDKVVVLWTANTERYSNVVVGLNDTMESLLDSLDKNEAEISPSTLYAIACVLENVPFINGSPQNTFVPGLIDLAIRRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKSTIVLHNTCEDSLLAAPIILDLVLLAELSTRIQLKTEGEGKFHSFHPVATILSYLTKAPLVPPGTPVVNALSKQRAMLENILRACVGLAPENNMILEYK

SEQ ID NO: 825 - protein, 510 aa, Castorbean
MFIEKFKVESPNVKYSEDEIHSVYNYETTELVHENRNGTYQWIVKPKTVQYEFKTDVHVPKLGVMLVGWGGNNGSTLTGGVIANREGISWATKDKVQQANYFGSLTQASSIRVGSFNGEEIYAPFKSLLPMVNPDDIVFGGWDISDMNLADAMARAKVLDIDLQKQLRPYMESMVPLPGIYDPDFIAANQGSRANNVIKGTKKEQMEQIVKDIREFKEKTKVDKVVVLWTANTERYSNVVVGLNDTMESLLASLERNEAEISPSTLYALACIFENVPFINGSPQNTFVPGVIDLAIKGNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 826 - protein, 510 aa, Cotton
MFIENFKVESPNVKYTENEIQSVYNYETTELVHENKNGTYQWVVKPKTVKYEFKTDIHVPKLGVMLVGWGGNNGSTLTGGVIANKEGISWATKDKVQQANYFGSLTQASTIRIGSYNGEEIYAPFKSLLPMVNPNDIVFGGWDISDMNLADAMARAKVFDIDLQKQLRPYMESMVPLPGIYDPDFIAANQGERANNVIKGTKKEQVQQVIKDIKEFKEKNKVDKVVVLWTANTERYSNVIVGLNDTVESLMASLEKNESEISPSTLYAIACVLENVPFINGSPQNTFVPGLIDLAIQRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKNTIVLHNTCEDSLLAAPIILDLVLLAELSTRIQFKADGEGKFHSFHPVATILSYLTKAPLVPPGTPVVNALSKQRAMLENILRASIGLAPENNMILEYK

SEQ ID NO: 827 - protein, 510 aa, Oak
MFIESFKVESPNVKYTENEIHSVYNYDTTELVHENRNGTYQWIVKPKTVKYEFKTDIHVPKLGVMLVGWGGNNGSTLTAGVIANREGISWATKDKVQQANYFGSLTQASTIRVGSFHGEEIYAPFKSLLPMVNPDDIVFGGWDISDMNLADAMARAKVLDIDLQKQLRPYMESMVPLPGIFDPDFIAANQGSRANNVIKGTKKEQVQQIIKDIREFKEATKVDKVVVLWTANTERYSNVIVGLNDTEESLLASVEKNEAEISPSTLYALACVYENIPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSSRIQLKAEGEGKFHSFHPVATILSYLTKAPLVPPGTPVVNALAKQRAMLENILRACVGLAPENNMILEYK

SEQ ID NO: 828 - protein, 510 aa, Pepper
MFIENFKVESPNVKYTESVIHSVYDYQTTELVHEEKNGTYQWTVKPKTVKYEFKTDVHVPKLGVMLVGWGGNNGSTLTGGVIANREGISWATKDKVQQANYFGSLTQASTIRVGSFNGEEIYAPFKSILPMVNPDDVVFGGWDISNMNLADAMARAKVFDIDLQKQLRPYMESMVPLPGIYDPDFIAANQGSRANNVVKGTKKEQIDQIIKDIREFKEKNNVDKVVVLWTANTERYSNVAVGLNDTMENLFTAVDRNEAEISPSTLYAIACILENVPFINGSPQNTFVPGFIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 829 - protein, 510 aa, Tabernaemontana
MFIESFKVDSANVKYSESEIHSIYNYETTELVHENRDGAYQWIVKPKTVKYEFKTDTRVPKLGVMLVGWGGNNGSTLTGGVISNREGISWATKDKVQQANYFGSLTQASTIRVGSFNGEEIYAPFKSLLPMVNPDDIVFGGWDISNMNLADAMARAKVLDIDLQKQLRPYMESMVPLPGIYEPDFIAANQGARANNVIKGTKKEQMQQIIKDIQEFKEKNKVDKVVVLWTANTERYSNVVVGLNDTMENLFAALDRNEAEISPSTLYAIACVLENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGKSTIVLHNTCEDSLLAAPIILDLVLLAELSSRIQLKSEAEAKFHSFHPVATILSYLTKAPLVPPGTPVVNALAKQRAMLENILRACVGLAPENNMILEYK

SEQ ID NO: 830 - protein, 510 aa, Cotton, Gossypium raimondii
MFIESFKVESPNVKYTENEIQSVYNYETTELVHENKNGTYQWVVKPKTVKYEFKTDIHVPKLGVMLVGWGGNNGSTLTGGVIANKEGISWATKDKVQQANYFGSLTQASTIRVGSYNGEEIYAPFKSLLPMVNPNDIVFGGWDISDMNLADAMARAKVFDIDLQKQLRPYMESMVPLPGIYDPDFIAANQGERANNVMKGTKKEQVQQVIKDIREFKEKNKVDKVVVLWTANTERYSNVIVGLNDTVESLMASLEKNESEISPSTLYAIACVLENVPFINGSPQNTFVPGLIDLAIQRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKNTIVLHNTCEDSLLAAPIILDLVLLAELSTRIQFKADGEGKFHTFHPVATILSYLTKAPLVPPGTPVVNALSKQRAMLENILRASIGLAPENNMILEYK

SEQ ID NO: 831 - protein, 510 aa, Tomato
MFIENFKVESPNVKYTESEIHSVYDYQTTELVHEEKNGTFQWTVKPKTVKYEFKTDVHVPKLGVMLVGWGGNNGSALTGGVIANREGISWATKDKVQQANYFGSLTQASTIRVGSFNGEEIYAPFKSILPMVNPDDVVFGGWDISNMNLADAMARAKVFDIDLQMQLRPYMESMVPLPGIYDPDFIAANQGSRANNVIKGTKKEQIDQIIKDIREFKENNKVDRVVVLWTANTERYSSVAVGFNDTMENLFASVDRNEAEISPSTLYAIACILENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGRNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 832 - protein, 246 aa, Solanum phureja
MFIENFKVESPNVKYTESEIHSVYDYQTTELVHEEKNGTFQWTVKPKTVKYEFKTDVHVPKLGVMLVGWGGNNGSALTGGVIANREGISWATKDKVQQANYFGSLTQASTIRVGSFNGEEIYAPFKSILPMVNPDDVVFGGWDISNMNLADAMARAKVFDIDLQKQLRPYMESMVPLPGIYDPDFIAANQGSRANNVIKGTKKEQIDQIIKDIREFKENNKVDKVVVLWTANTERYSSVAVGLNWP

SEQ ID NO: 833 - protein, 510 aa, Chestnut
MFIESFKVDSPNVKYTENEIHSLYNYDTTELVHENRNGTYQWIVKPKTVKYEFKTDIHVPKLGVMLVGWGGNNGSTLTAGVIANREGISWATKDKVQQANYFGSLTQASTIRVGSFHGEEIYAPFKSLLPMVNPDDIVFGGWDISDMNLADAMARAKVLDIDLQKQLRPYMESMVPLPGIFDPDFIAANQGSRANNVIKGTKKEQVQQIIKDIREFKEANKVDKVVVLWTANTERYSNVIVGLNDTEENLLASVEKNEAEISPSTLYALACVYENIPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSSRIQLKAEGEGKFHSFHPVATILSYLTKAPLVPPGTPVVNALAKQRAMLENILRACVGLAPENNMILEYK

SEQ ID NO: 834 - protein, 510 aa, Flaveria
MFIESFKVESPNVKYTDDEIHSLYNYDTTELVHEEKNGAYQWVVKPKTVKYEFKTQTRVPKLGVMLVGWGGNNGSTLTAGVIANREGISWATKEKVQQANYFGSLTQASTIRVGSFNGEEIYAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 835 - protein, 510 aa, Kiwi
MFIESFKVESPNVKYTEGEIHSVYNYETTELVHENRNGNYQWIVKPKTVQYEFKTDTHVPKLGVLLVGWGGNNGCTLTGGVIANREGISWATKDKVQQANYFGSLTQASTIRVGSFNGEEIYAPFKSILPMVNPDEIVFGGWDISDMNLADAMARARVFDIDLQKQLRPYMESMVPLPGIYDPDFIAANQGSRANNVIKGTKKEQLDQIIKDIREFKEKNKVDRVVVLWTANTERYSNVIVGLNDTMENLFASLEKNEAEISPSTLYAIACVLENIPFINGSPQNTFVPGLIDLAIRRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKADGEGKFHSFHPVATILSYLTKAPLVPPGTPVVNALSKQRAMLENILRACIGLSPENNMILEYK

SEQ ID NO: 836 - protein, 510 aa, Platanus
MFIESFKVESPNVKYTDHEIQSIYSYETTELVHENRNGTYQWVVKPKTVQYEFKTDTCVPKLGVMLVGWGGNNGSTLTGGVIANREGISWATKDKVQQANYFGSLTQASTIRVGSFDGEEIYAPFKSLLPMVNPDDIVFGGWDISDMNLADSMARAKVLDIDLQRQLRPYMESMVPLPGIYNPDFIAANQGSRANNVIKGTKKEQVEQIMKDIREFKEANKVDKVVVLWTANTERYSNVVVGLNDTMENLSASLDKNEDEISPSTMYALACILENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 837 - protein, 510 aa, Platanus
MFIESFKVESPNVKYTDHEIQSVYSYETTELVHENKNGTYQWLVKPKTVQYEFKTDTRVPKLGVMLVGWGGNNGSTLTGGVIANREGISWATKDKVQQANYFGSLTQASTIRVGSFNGEEIYAPFKSLLPMVNPDDIVFGGWDISDMNLADAMARAKVLDIDLQRQLRPYMESMVPLPGIYDSDFIAANQGSRANNVIKGTKKEQVQQIMKDIREFKEANKVDKVVVLWTANTERYSNVVVGLNDTMENLLASLEKNEVEISPSTLYALACVFENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGRSTIVLHNTCEDSLLAAPIILDLVLLAELSTRIQLKAEGEGKFHSFHPVATILSYLTKAPLVPPGTPVVNALSKQRAMLENIMRACIGLAPENNMILEYK

SEQ ID NO: 838 - protein, 331 aa, Vinca
MFIESFKVDSANVKYTESEIHSVYNYETTELVHENRDGTYQWIVKPKTVKYEFKTDTLVPKLGIMLVGWGGNNGSTLTAGVIANREGISWATKDKVQRANYFGSLTQASTIRVGSFNGEEIYAPFKSLLPMVNPDDIVFGGWDISNLNLADAMARGKVLDIDLQKQLRPYMESMVPLPGIYEPDFIAANQGSRANNVLKGTKKEQMQQIIKDIKEFKEKNKVDKVVVLWTANTERYSNVVVGLNDTVENLFAALDRNEAEISPSTLYAIACVLENVPFINGSPQNTFVPGLIDLAIKRNSLIGGDDFKSGQTKMKSVLVDFLVGAGIKPIL

SEQ ID NO: 839 - protein, 510 aa, Amsonia
MFIESFKVDSANVKYTESEIHSVYDYQTTELVHENRDGTYQWIVKPKSVKYEFKTDTRVPKLGVMLVGWGGNNGSTLTGGVIANREGISWATKDKVQQANYFGSLTQASTVRVGSFNGEEIYAPFKSLLPMVNPEDIVFGGWDISNMSLADAMARAKVLDIDLQKQLRPYMESMVPLPGIYDPDFIAANQGSRANNVIKGTKKEQMLQIIKDIREFKEKNKVDKVVVLWTANTERYSNVVVGLNDTVENLFAALDRNEAEISPSTLYAIACVLENVPFINGSPQNTFVPGLIDLAIRRNSLIGGDDFKSGQTKIKSVLVDFLVGAGIKPTSIASYNHLGNNDGMNLSAPQTFRSKEISKSNVVDDMVASNAILYEPGEHPDHVVVIKYVPYVGDSKRAMDEYTSEIFMGGKNTIVLHNTCEDSLLAAPIILDLVLLAELSTRIQLKSEAEGKFHSFHPVATILSYLTKAPLVPPGTPVVNALSKQRAMLENIMRACVGLAPENNMILEYK

SEQ ID NO: 840 - protein, 510 aa, Beech
MFIESFKVDSPNVKYTENEIHSVYNYDTTELVHENRNGTYQWIIKPKTVKYEFKTETHVPKLGVMLVGWGGNNGSTLTAGVIANREGISWATKDKVQQANYFGSLTQASTIRVGSFHGEEIYAPFKSLLPMVHPDDIVFGGWDISDMNLADAMARAKVLDIDLQKQLRPYMESMVPLPGIFDPDFIAANQGARANNVIKGTKKEQVQQIIKDIREFKEATKVDKVVVLWTANTERYSNVIVGLNDTEESLLASVDKNEAEISPSTLYALACILENVAFINGSPQNTFVPGLIELAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSSRIQLKAEGEGKFHSFHPVATILSYLTKAPLVPPGTPVVNALSKQRAMLENIMRACVGLAPENNMILEYK

SEQ ID NO: 841 - protein, 510 aa, Cotton, Gossypium raimondii
MFIESFKVESPNVKYTDNAIQSVYNYETTELVHENRDGTYQWVVKPKTVKYEFRTDIHVPKLGVMLVGWGGNNGSTLTGGVIANRWGVSWATKDKVQQANYFGSLTQASTIRVGSYNGEEIYAPFKSLLPMVNPEDIVFGGWDISDMNLADAMARAKVFDIDLQKQLRPYMESMVPLPGIYDPDFIAANQGERANNVIKGTKKEQVQQIIKDIREFKEKNKVDKVVVLWTANTERYSNVVVGLNDTMENLLASFEKNESEISPSTLYAIACVFEDVPFINGSPQNTFVPGLIDLAIQRNCLIGGDDFKSGQTKMKSVLVDFLVGAGIKPTSIVSYNHLGNNDGMNLSAPQTFRSKEISKSNVVDDMVSSNGILYQPGEHPDHVVVIKYVPYVGDSKRAMDEYTSEIFMGGKNTIVLHNTCEDSLLAAPIILDLVLLAELSTRIQLKAEGEGKFHSFHPVATILSYLTKAPLVPPGTPVVNALSKQRAMLENILRACIGLSPENNMILEYK

SEQ ID NO: 842 - protein, 510 aa, Kiwi
MFIESFKVESPNVKYTEGEIHSVYSYETTELVHENRNGTYQWVVKPKTVQYEFKTDTHVPKLGVMLVGWGGNNGCTLTGGVIANREGISWATKDKVQQANYFGSLTQASTIRVGSFNGEEIYAPFKSILPMVNPDEIVFGGWDISDMNLADAMARARVFDIDLQKQLRPYMESMVPLPGIYEPDFIAANQGSRANNVIKGSKKEQVDQIIKDIREFKEKNKVDRVVVLWTANTERYSNVIVGLNDTMENLFAALEKNEAEISPSTLYAIACVLENIPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKADGEGKFHSFHPVATILSYLTKAPLVPPGTPVVNALSKQRAMLENILRACIGLSPENNMILEYK

SEQ ID NO: 843 - protein, 510 aa, Phlya
MFIESFKVDSPNVKYTEGEIHSVYNYETTELVHENRNGTYQWIVKPKTVEYQFKTDTHVPKLGVMLVGWGGNNGSTLTGGVIANREGISWATKDKVQQANYFGSLTQASSIRVGSFNGEEIYAPFKSLLPMVNPDDVVFGGWDISNMNLADAMGRAKVLDIDLQKQLRPYMEHMVPLPGIYDPDFIAANQGPRANNVIKGTKKEQVQQVIKDIREFKEKNKVDKVVVLWTANTERYSNVIVGLNDTSESLMAAVERNEAEISPSTLYAIACVLENVPFINGSPQNTFVPGMIDLAIQHNTLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGKSTIVLHNTCEDSLLAAPIILDLVLLAELSTRIQLKAQGEGKFHSFHPVATILSYLTKAPLVPPGTPVVNALSKQRAMLENILRACVGLAPENNMILEYK

SEQ ID NO: 844 - protein, 510 aa, Tomato
MFIENFKVESPNVKYIENEIHSVYDYETTELVHEERNGTYQWIVKPKTVKYEFKTDTHVPKLGVMLVGWGGNNGSTLTGGVIANREGISWATKEKVQQANYFGSLTQASTIRVGSFNGEEIYAPFKSLLPMVNPDDVVFGGWDISNMNLADAMVRAKVFEVDLQKQLRPYMESMVPLPGIYDPDFIAANQEARANNVIKGTKKEQVEQIVKDIREFKEKNKVDKIVVLWTANTERYSNVVVGLNDTMENLLAAVDRNEAEISPSTLHAIACIMENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVASNAILYESGEHPDHVVVIKYVPYVGDSKRAMDEYMSEIFMGGKSTIVMHNTCEDSLLAAPIILDLVLLAELSTRIQLKAEGEGKFHSFHPVATILSYLTKAPLVPPGTPVVNALSKQRAMLENIMRACVGLAPENNMILEYK

SEQ ID NO: 845 - protein, 364 aa, Catharanthus
MNLADAMARAKVFEIDLQNQLRPYMESMVPLPGIYDPDFIAANQGSRANNVIKGTKKEQMQQIIKDIQEFKEKNKVDKVVVLWTANTERYSNLVVGLNDTMENLFAALDRNEAEISPSTLYALACVLENVPFINGSPQNTFVPALIDLAIKRNSLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGKNTIVLHNTCEDSLLAAPIILDLVLLAELSTRIQLKSEAEGKFHSFHPVATILSYLTKAPLVPPGTPVVNALSKQRAMLENIMRACVGLAPENNMILEYK

SEQ ID NO: 846 - protein, 510 aa, Cacao
MFIESFKVESPNVKYTDNEILSVYNYETTELVHENRNGTYQWVVKPKTVKYEFKTDTHVPKLGVMLVGWGGNNGSTLTGAVIANREGISWATKDKVQQANYFGSLTQASTIRVGSYNGEEIYAPFKSLLPMVNPEDIVFGGWDISDMNLADAMARAKVFDIDLQKQLRPYMESTVPIPGIYDPDFIAANQGERANNIIKGTKKEQVQQIIKDIREFKEKNKVDRVVVLWTANTERYSNVIVGLNDTMESLLGSLEKNESEISPSTLYAIASVLENVPFINGSPQNTFVPGLIDLAIQRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGQNTIVLHNTCEDSLLAAPIILDLVLLAELSTRIQLKAEGEGKFHSFHPVATILSYLTKAPLVPPGTPVVNALSKQRAMLENILRACIGLAPENNMILEYK

SEQ ID NO: 847 - protein, 511 aa, Clover
MFIENFKVESPNVKYTETEIESVYSYETTELVHQKNTNDTYEWVVKPKTVKYEFKTQTNLPKLGVMLVGWGGNNGSSLTGGVIANREGISWATKDNIQQANYFGSLTQASAIRVGSFQGEEIYAPFKSLLPMVNPEDIVWGGWDISDMNLADAMGRAKVFDIDLQKQLRPYMESMVPLPGIYDPDFIAANQGDRANNIIKGTKKEQLQQVIKDIKEFKEANKVDKVVVLWTANTERYSNIVVGLNDTMENLLASVDKNESEISPSTLFALACVLENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYGPGEHPDHVVVIKYVPYVGDSKRAMDEYTSEIFMGGKNTIVMHNTCEDSLLAAPIILDLVLLAELSTRIQFKSEHEDKFHTFHPVATILSYLTKAPLVPPGTPVVNALSKQRSMLENILRACVGLAPENNMILEYK

SEQ ID NO: 848 - protein, 510 aa, Euonymus
MFIENFKVESPNVKYTETEIHSVYNYETTELVHENKNGSYQWTVKPKTVKYEFKTDTSVPKLGVMLVGWGGNNGSTLTGGVIANREGISWATKDKVQQANYFGSLTQASSIRVGSYNGEEVYAPFKSLLPMVNPDEIVFGGWDISDMNLADAMARAKVFDIDLQKQLMPYMEHMVPLPGIYDPDFIAANQDSRANNIIKGTKKEQVQQVIKDIREFKEKTKVDKVVVLWTANTERYSNVIVGLNDTIENLFASLDKDEAEISPSTLYALACILENIPFINGSPQNTFVPGLIDLAIKRNSLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGRNTIVLHNTCEDSLLAAPIILDLVLLAELSTRIQLKADDEGKFHSFHPVATILSYLTKAPLVPPGTPVVNALSKQRAMLENILRACVGLAPENNMILEYK

SEQ ID NO: 849 - protein, 510 aa, Flaveria
MFIESFKVESPNVKYTDDEIHSLYNYDTTELIHEEKNGAYQWVVKPKTVKYEFKTKTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 850 - protein, 510 aa, Flaveria
MFIESFKVESPNVKYTDDEIHSLYNYDTTELIHEEKNGAYQWVVKPKTVKYEFKTQTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 851 - protein, 510 aa, Flaveria
MFIESFKVESPNVKYTEDEIHSLYNYDTTELLHEEKDGAYQWVVKPKTVKYEFKTQTRVPKLGVMLVGWGGNNGSTLTAGVIANREGISWATKEKVQQANYFGSLTQASTIRVGSFNGEEIYAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFLGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 852 - protein, 510 aa, Poplar
MFIEKFKVESPNVKYTEDEIHSVYNYETTELVHENKNGSYQWTVKPKTVQYEFKTDIHVPKLGVMLVGWGGNNGSTLTGGVIANREGISWATKDKVQQANYFGSLTQASSIRVGSFNGEEIYAPFKSLLPMVNPDDIVFGGWDISDMNLADAMARAKVFDIDLQKQLRPYMESMAPLPGIYDPDFIAANQGSRANNVIKGTKKEQVQQIIEDIREFKEKNKVDKVVVLWTANTERYSNIVVGLNDTMENLLAAVEKDESEISPSTLYALACIYENIPFINGSPQNTFVPGLVDLAIKRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKNTIVLHNTCEDSLLAAPIILDLVLLAELSTRIQLKGEAEGKFHSFHPVATILSYLTKAPLVPPGTPVVNALSKQRAMLENILRACVGLAPENNMILEYK

SEQ ID NO: 853 - protein, 510 aa, Clementine
MFIENFKVESPNVKYTDNEIHSVYDYETTELVHENRNGTYQWIVKPKTVKYEFKTDVHVPKLGVMLVGWGGNNGSTLTGGVIANREGISWATKDTVQQANYFGSLTQASAIRVGSYNGEEIYAPFKSILPMVNPDDIVFGGWDISDMNLADAMARARVFDIDLQKQLRPYMESMVPLPGIYDLDFIAANQGSRANNVIKGTKKEQMLQIIKDIREFKEKNKVDRVVVLWTANTERYSNVIVGLNDTVENLLASLDKNEAEISPSTLYAIACVLENIPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNGILYGPGEHPDHVVVIKYVPYVGDSKRAMDEYTSEIFMGGKNTIVLHNTCEDSLLAAPIVLDLVLLAELSTRIQLKAEGEGKFHSFHPVATILSYLTKAPLVPPGTPVVNALSKQRAMLENILRACVGLAPENNMILEYK

SEQ ID NO: 854 - protein, 510 aa, Coffea
MFIENFKVDSPNVKYSESEIHSVYNYETTELVHENRDGTYQWIVKPKSVQYEFRTDIHVPKLGVMLVGWGGNNGSTLTGGVIANREGISWATKDKVQQANYFGSLTQASSIRVGSFNGEEIYAPFKSLLPMVNPEDIVFGGWDISNLNLADAMARAKVLDIDLQKQLRPYMESMVPLPGIYDPDFIAANQGSRANNLIKGTKKEQVEQVIKDIREFKEKNKVDKIVVLWTANTERYSNVAVGLNDTTENLLAALDRNEAEISPSTLYAIACMYENVPFINGSPQNTFVPGLIDLAIKRNCLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGKSTIVLHNTCEDSLLAAPIILDLVLLAELSTRIQLKAEGEGKFHSFHPVATILSYLSKAPLVPPGTPVVNALSKQRAMLENILRACVGLAPENNMILEYK

SEQ ID NO: 855 - protein, 510 aa, Flaveria
MFIESFKVESPNVKYTDDEIHSLYNYDTTELIHEEKNGAYQWVVKPKTVKYEFKTKTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFLGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 856 - protein, 510 aa, Flaveria
MFIESFKVESPNVKYTDDEIHSLYNYDTTELIHEEKNGAYQWVVKPKTVKYEFKTKTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPGNNMILEYK

SEQ ID NO: 857 - protein, 510 aa, Orange
MFIENFKVESPNVKYTDHEIHSVYDYETTELVHENRNGTYQWIVKPKTVKYEFKTDVHVPKLGVMLVGWGGNNGSTLTGGVISNREGISWATKDTVQQANYFGSLTQASAIRVGSYNGEEIYAPFKSILPMVNPDDIVFGGWDISDMNLADAMARARVFDIDLQKQLRPYMESMVPLPGIYDPDFIAANQGSRANNVIKGTKKEQMLQIIKDIREFKEKNKVDRVVVLWTANTERYSNVIVGLNDTVENLLASLDKNEAEISPSTLYAIACVLENIPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNGILYGPGEHPDHVVVIKYVPYVGDSKRAMDEYTSEIFMGGKNTIVLHNTCEDSLLAAPIVLDLVLLAELSTRIQLKAEGEGKFHSFHPVATILSYLTKAPLVPPGTPVVNALSKQRAMLENILRACVGLAPENNMILEYK

SEQ ID NO: 858 - protein, 510 aa, Sunflower
MFIESFKVESPNVKYSEDEIHSLYNYDTTELVHEEKNGAYQWVVKPKTVKYEFKTQTNVPKLGVMLVGWGGNNGSTLTAGVIANREGISWATKEKVQQANYFGSLTQASTIRVGSFNGEEIYAPFKSLLPMVNPDDIVFGGWDISSMNLADSMARAKVLDIDLQKQLRPYMESMVPLPGVFDPDFIAANQGERADNVIKGTKNEQIQKIIKDIREFKEANKVDKVVVLWTANTERYSNVMVGLNDTMESLFASLDRNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAETEGKFHSFHPVATILSYLTKAPLVPPGTPVVNALAKQRAMLENIMRACVGLAPENNMILEYK

SEQ ID NO: 859 - protein, 510 aa, Tobacco
MFIENFKVESPNVKYTENEIRSVYDYQTTELVHEEKNGSYQWTVKPKCVKYEFKTDTNVPKLGVMLVGWGGNNGSTLTGGIIANKEGISWATKEKVQQANYFGSLTQASTIRVGSFNGEEIYAPFKSLLPMVNPDDVVFGGWDISNMNLADAMVRAKVFDIDLQNQLRPYMESMVPLPGIYDPDFIAANQESRANNVIKGTKKEQVDQIVKDIREFKEKNKVDKIVVLWTANTERYSNVIVGLNDTMENLLAAVDRDEAEISPSTLYAIACVLENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVSSNAILYEAGEHPDHVVVIKYVPYVGDSKRAMDEYTSEIFMGGKNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 860 - protein, 510 aa, Ambrosia
MFIESFKVESPNVKYTEDEIHSLYNYDTTELVHEEKNGAYQWVVKPKTVKYEFKTQTNVPKLGVMLVGWGGNNGSTLTAGVIANREGISWATKEKVQQANYFGSLTQASTIRVGSYNGEEIYAPFKSLLPMVNPDDIVFGGWDISSMNLADSMARAKVLDIDLQKQLRPYMESMVPLPGIFDPDFIAANQGERADNVIKGTKNEQIQKVIKDIREFKEANKVDKVVVLWTANTERYSNVMVGLNDTMESLFASLDRNEAEISPSTLFAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAETEGKFHSFHPVATILSYLTKAPLVPPGTPVVNALAKQRAMLENIMRACVGLAPENNMILEYK

SEQ ID NO: 861 - protein, 510 aa, Cirsium
MFIESFKVESPNVKYTPDEIHSLYNYDTTELVHEEKDGAFQWVVKPKTVKYEFKTQTHVPKLGVMLVGWGGNNGSTLTAGVIANREGISWATKDKVQQANYFGSLTQASTIRVGSFNGEEIYAPFKSLLPMVNPDDIVFGGWDISSMNLADSMARARVLDIDLQKQLRPYMESMVPLPGIFDPDFIAANQGSRADNVIKGTKNEQIQKIIKDIREFKEANKVDKVVVLWTANTERYSNVVVGLNDTMENLFASIDKNEAEISPSTLYAIACILENVPFINGSPQNTFVPGVIDLAIQRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSTRIQLKAESEGKFHSFHPVATILSYLTKAPLVPPGTPVVNALAKQRAMLENILRACVGLAPENNMILEYK

SEQ ID NO: 862 - protein, 510 aa, Euonymus
MFIENFKVESPNVKYTETEIHSVYNYETTELVHENKNGSYQWTVKPKTVKYEFKTDTSVPKLGVMLVGWGGNNGSTLTGGVIANREGISWATKDKVQQANYFGSLTQASSIRVGSYNGEEVYAPFKSLLPMVNPDEIVFGGWDISDMNLADAMARAKVFDIDLQKQLMPYMEHMIPLPGIYDPDFIAANQDSRANNIIKGTKKEQVQQVIKDIREFKEKTKVDKVVVLWTANTERYSNVIVGLNDTIENLFASLDKDEAEISPSTLYALACILENIPFINGSPQNTFVPGLIDLAIKRNSLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGRSTIVLHNTCEDSLLAAPIILDLVLLAELSTRIQLKADDEGKFHSFHPVATILSYLTKAPLVPPGTPVVNALSKQRAMLENILRACVGLAPENNMILEYK

SEQ ID NO: 863 - protein, 510 aa, Flaveria
MFIESFKVESPNVKYTDDEIHSLYNYDTTELIHEGENGAYQWVVKPKTVKYELQTQTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 864 - protein, 510 aa, Monkeyflower
MFIESFKVESPNVKYTEDDIQSVYNYETTELVHESRNGTYQWIVKPKTVKYEFKTDTHVPKLGVMLVGWGGNNGSTLTAGVIANREGISWATKDKVQQANYFGSLTQASSIRVGSFNGEEIYAPFKSLLPMVNPDDVVFGGWDISDMNLADAMGRAKVLDIDLQKQLRPYMEHMVPLPGIYDADFIAANQGSRANNVIKGTKKEQVQQLIKDIREFKEKNKVDRIVVLWTANTERYSNVVVGLNDTMENLMASVDKNEAEISPSTLFAIACVLENIPFINGSPQNTFVPGLIEMAIQRNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKSTIVLHNTCEDSLLAAPIILDLVLLAELSTRIQLKAEGEGKFHTFHPVATILSYLTKAPLVPPGTPVVNALSKQRAMLENIMRACVGLAPENNMILEYK

SEQ ID NO: 865 - protein, 510 aa, Parthenium
MFIENFKVESPNVKYSEDEIHSLYNYDTTELVHEEKNGAYQWVVKPKTVKYEFKTQTHVPKLGVMLVGWGGNNGSTLTAGVIANREGISWATKEKVQQANYFGSLTQASTIRVGSYNGEEIYAPFKSLLPMVNPDDIVFGGWDISSMNLADSMARAKVLDIDLQKQLRPYMESMVPLPGIFDPDFIAANQGERADNVIKGTKNEQIQKIIKDIREFKETNKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAETEGKFHSFHPVATILSYLTKAPLVPPGTPVVNALAKQRAMLENIMRACVGLAPENNMILEYK

SEQ ID NO: 866 - protein, 510 aa, Prunus
MFIESFKVESPNVKYTENEIHSVYSYETTELVHEERKGTYQWIVKPKTVKYEFKTDIHVPKLGVMLVGWGGNNGSTLTAGVIANREGISWATKDKVQQANYFGSLTQASSIRVGSFNGEEIYAPFKSLLPMVNPDDIVFGGWDISDMNLADAMARARVLDIDLQKQLRPYMESMLPLPGIYDPDFIAANQGARANNVIKGTKKEQVQQIIEDIREFKEQNKVDKVVVLWTANTERYSNVVVGLNDTVENLLGSVDKNEAEISPSTLYAIACVLENVPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVADSKRAMDEYTSEIFLGGKNTIVMHNTCEDSLLAAPIILDLVLLAELSTRIQLKSEAEGKFHSFHPVATILSYLSKAPLVPPGTPVVNALSKQRAMLENILRACVGLAPENNMILEYK

SEQ ID NO: 867 - protein, 327 aa, Phlya
MFIESFKVDSPNVKYTEGEIHSVYNYETTELLHENRNGAYQWTVKPKTVKYEFKTDTHVPKLGVMLVGWGGNNGSTLTAGVIANREGISWATKDKVQQANYFGSLTQASSIRVGSFNGEEIYAPFKSLLPMVNPDEIVFGGWDISNMNLADAMGRAKVLDIDLQKQLRPYMEHMVPLPGIYDPDFIAANQGARANNVIKGTKKEQVEQLIEDIREFKEQNKVDSVVVLWTANTERYSNVVVGLNDTTENLMASLERNEAEISPSTLFGLACVLENVPFINGSPQNTFVPGLIELAIQRNCLIGGDDFKSGQTKMKSVLVRFSCWSWY

SEQ ID NO: 868 - protein, 446 aa, Pteridium
MLVGWGGNNGSTLTGAVIANREGISWATKDKVQQANYFGSLTQASTIRVGSYNGEEIYAPFKSLLPMVNPEDIVFGGWDISDMNLADAMARAKVFDIDLQKQLRPYMESTVPIPGIYDPDFIAANQGERANNIIKGTKKEQVQQIIKDIREFKEKNKVDRVVVLWTANTERYSNVIVGLNDTMESLLGSLEKNESEISPSTLYAIASVLENVPFINGSPQNTFVPGLIDLAIQRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGQNTIVLHNTCEDSLLAAPIILDLVLLAELSTRIQLKAEGEGKFHSFHPVATILSYLTKAPLVPPGTPVVNALSKQRAMLENILRACIGLAPENNMILEYK

SEQ ID NO: 869 - protein, 510 aa, Ambrosia
MFIESFKVESPNVKYAEDEIHSLYNYDTTELVHEEKNGSYQWVVKPKTVKYEFKTQTHVPKLGVMLVGWGGNNGSTLTAGVIANREGISWATKEKVQQANYFGSLTQASTIRVGSYNGEEIYAPFKSLLPMVNPDDIVFGGWDISSMNLADSMARAKVLDIDLQKQLRPYMESMVPLPGIFDPDFIAANQGERADNVIKGTKNEQIQKVIKDIREFKEANKVDKVVVLWTANTERYSNVMVGLNDTMESLFASLDRNESEISPSTLFAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAETEGKFHSFHPVATILSYLTKAPLVPPGTPVVNALAKQRAMLENIMRACVGLAPENNMILEYK

SEQ ID NO: 870 - protein, 510 aa, Aristolochia
MFIENFRVESPNVKYIDGEIQSVYNYETTELVHENRNGVYQWIVKPKTVQYEFKTDTRVPKLGVMLVGWGGNNGSTLTAGVIANREGISWATKDKVQQANYFGSLTQASSIRVGSFNGEEIYAPFKSLLPMVNPDDVVFGGWDISNMNLADAMARAKVLDFDLQKQVRPYMESMVPLPGIYDPDFIAANQGSRANNVIKGTKKEQVEQIIKDIREFKEANKVDKVVILWTANTERYSNVVVGLNDTTENLLAALDRNESEISPSTLYALACVMENVPFINGSPQNTFVPGLIDLAITRNSLIGGDDFKSGQTKMKSVLVDFLVGAGIKPTSIVSYNHLGNNDGMNLSAPQTFRSKEISKSNVVDDMVSSNGILYAPGEHPDHVIVIKYVPYVGDSKRAMDEYTSEIFMGGKSTIVLHNTCEDSLLAAPIILDLVLLAELSTRVQLKAEGEAKFHSFHPVATILSYLTKAPLVPPGTPVVNALSKQRAMLENIMRACIGLAPENNMILEYK

SEQ ID NO: 871 - protein, 511 aa, Senecio
MFIESFKVESPNVKYTDTEIHSLYNYDTTELVHEENNNGAFQWVVKPKTVKYEFKTQTHVPKLGVMLVGWGGNNGSTLTAGVIANREGISWATKEKVQQANYFGSLTQASTIRVGSFNGEEIHAPFKSLLPMVNPDDIVFGGWDISKMNLADSMARAQVLDIDLQKQLRPYMESMVPLPGIYDADFIAANQGSRADNVIKGTKNEQIQKLIKDIREFKESNKVDKVVVLWTANTERYSNVVVGLNDTMESLFASLDRNESEISPSTLFAIACILENVPFINGSPQNTFVPGVIELAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVMHNTCEDSLLAAPIILDLVLLAELSTRIELKSETEGKFHSFHPVATILSYLTKAPLVPPGTPVVNALAKQRAMLENIMRACVGLAPENNMILEYK

SEQ ID NO: 872 - protein, 510 aa, Tripterygium
MFIENFKVESPNVKYTGTEIHSVYNYETTELLHENRNGSYQWTVKPKTVQYEFKTDTSVPKLGVMLVGWGGNNGSALTGGVIANREGISWATKDKVQQANYFGSLTQASSIRVGSYNGEEIYAPFKSLLPMVNPDEIVFGGWDISDMNLADAMARAKVFDIDLQKQLRPYMEHMVPLPGIYDPDFIAANQDSRANNVIKGTKKEQVQQVIKDIREFKEKTKVDKVVVLWTANTERYSNVIVGLNDTIENLFASLEKDEAEISPSTLYALACILENIPFVNGSPQNTFVPGLIDLAIKNNSLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGRNTIVLHNTCEDSLLAAPIILDLVLLAELSTRIQIKAEDEGKFHSFHPVATILSYLTKAPLVPPGTPVVNALSKQRAMLENILRACVGLAPENNMILEYK

SEQ ID NO: 873 - protein, 510 aa, Artemisia
MFIESFKVESPNVKYSEDEIHSVYDYDTTELVHEEKNGAYQWVVRPKTVKYEFKTQTNVPKLGVMLVGWGGNNGSTLTAGVIANREGISWATKDKVQQANYFGSLTQASTIRVGSFNGEEIYAPFKSLLPMVNPDDIVFGGWDISSMNLADAMARARVLDIDLQKQLRPYMESMVPLPGIFDPDFIAANQGSRADNVIKGTKNEQIQKIIKDIREFKEANKVDKVVVLWTANTERYSNVVVGLNDTMENMFASLDRNEAEISPSTLYAIACILENVPFINGSPQNTFVPGVIELAIKHNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVADSKRAMDEYTSEIFMGGTNTIVMHNTCEDSLLAAPIILDLVLLAELSTRIELKSEAEGKFHSFHPVATILSYLTKAPLVPPGTPVVNALAKQRAMLENIMRACVGLAPENNMILEYK

SEQ ID NO: 874 - protein, 510 aa, Potato
MFIENFKVESPNVKYIENEIHSVYDYETTELVHEERNGTYQWIVKPKSVKYEFKTDTHVPKLGVMLVGWGGNNGSTLTGGVIANREGISWATKEKVQQANYFGSLTQASTIRVGSYNGEEIYAPFKSLLPMVNPDDVVFGGWDISNMNLADAMVRAKVFEVDLQKQLRPYMESMVPLPGIYDPDFIAANQEARANNVIKGTKKEQVDQIVKDIREFKEKNKVDKIVVLWTANTERYSNVVVGLNDTMENLLAAVDRNEAEISPSTLHAIACILENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVASNSILYESGEHPDHVVVIKYVPYVGDSKRAMDEYMSEIFMGGKSTIVMHNTCEDSLLAAPIILDLVLLAELSTRIQLKAEGEGKFHSFHPVSTILSYLTKAPLVPPGTPVVNALSKQRAMLENIMRACVGLAPENNMILEYK

SEQ ID NO: 875 - protein, 510 aa, Rose
MFIESFKVESPNVEYTENEIHSVYTYETTELVHENRKGTYQWIVKPKSVKYEFKTDVHVPKLGVMLVGWGGNNGSTLTAGVIANREGISWATKDKVQQANYFGSLTQASSIRVGSFNGEEIYAPFKSLLPMVNPDDIVFGGWDISDMNLADAMARARVLDIDLQKQLRPYMESMVPLPGIYDPDFIAANQGSRANNVIKGTKQEQVQQIIKDIREFKEKNKVDKVVVLWTANTERYSNVMEGLNDTVENLLGSVDKNEAEISPSTLYAIACVMENVPFINGSPQNTFVPGLIDLAIRRNTLIGGDDFKSGQTKMKSVLVDFLVGAGIKPTSIVSYNHLGNNDGMNLSAPQTFRSKEISKSNVVDDMVSSNGILFEPGEHPDHVVVIKYVPYVADSKRAMDEYTSEIFLGGRNTIVMHNTCEDSLLAAPIILDLVLLAELSTRIQLKSEDEGKFHSFHPVATILSYLTKAPLVPPGTPVVNALSKQRAMLENILRACVGLAPENNMILEYK

SEQ ID NO: 876 - protein, 510 aa, Solanum phureja
MFIENFKVESPNVKYIENEIHSVYDYETTELVHEERNGTYQWIVKPKSVKYEFKTDTHVPKLGVMLVGWGGNNGSTLTGGVIANREGISWATKEKVQQANYFGSLTQASTIRIGSYNGEEIYAPFKSLLPMVNPDDVVFGGWDISNMNLADAMVRAKVFEVDLQKQLRPYMESMVPLPGIYDPDFIAANQEARANNVIKGTKKEQVDQIVKDIREFKEKNKVDKIVVLWTANTERYSNVVVGLNDTMENLLAAVDRNEAEISPSTLHAIACILENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVASNSILYESGEHPDHVVVIKYVPYVGDSKRAMDEYMSEIFMGGKSTIVMHNTCEDSLLAAPIILDLVLLAELSTRIQLKAEGEGKFHSFHPVATILSYLTKAPLVPPGTPVVNALSKQRAMLENIMRACVGLAPENNMILEYK

SEQ ID NO: 877 - protein, 510 aa, Triphysaria
MFIDSFKVDSPNVKYTETEIHSVYNYETTELVHENRNGTYQWIVKPKTVKYEFKTEAIVPKLGVMLVGWGGNNGTTLTAGVIANREGISWATKEKVQQANYFGSLTQASSIRVGSFNGEEIYAPFKSLLPMVNPDEIVFGGWDISNMNLADAMGRAKVLDIDLQKQLRPYMEQMVPLPGIYNPDFIAANQGSRADNLIKGTKKEQVQQLIKDIREFKEQNKVDRIVVLWTANTERYSNVAVGLNDTMENLMASVDRDEAEISPSTLFAIACILENVPFINGSPQNTFVPGLIELAIQRNSLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYMSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 878 - protein, 510 aa, Apple
MFIDSFKVESPNVAYTENEIHSVYNYETTELVHENRNGAYQWIVKPKTVKYEFKTDVHVPKLGVMLVGWGGNNGSTLTAGVIANREGISWATKDKVQQANYFGSLTQASSIRVGSFNGEEIYAPFKSLLPMVNPDDIVFGGWDISDMNLADAMARAKVLDIDLQKQLRPYMESMLPLPGIYDPDFIAANQGARANNVIKGTKKEQLQQVIKDIREFKEKNKVDRVVVLWTANTERYSNVVVGLNDTVENLLGSVDKNEAEISPSTLYAIACVLENIPFINGSPQNTFVPGLIDLAIRRNSLIGGDDFKSGQTKMKSVLVDFLVGAGIKPTAIVSYNHLGNNDGMNLSAPQTFRSKEISKSNVVDDMVSSNGILYGPGEHPDHVVVIKYVPYVGDSKRALDEYTSEIFMGGQNTIVLHNTCEDSLLAAPIILDLVLLAELSTRIQLKSEAEAKFHSFHPVATILSYLSKAPLVPPGTPVVNALSKQRAMLENILRACVGLAPENNMILEYK

SEQ ID NO: 879 - protein, 510 aa, Aquilegia
MFIESFKVESPNVKYTDDEIHSVYNYETTELVHENKNGSYQWVVKPKSVQYEFKTDTHVPKLGVMLVGWGGNNGSTLTAGVIANREGISWATKDKVQQANYFGSLTQASTIRVGSFNGEEIYAPFKSLLPMVNPDDVVFGGWDISDLNLADSMTRAKVLDIDLQKQLRPYMESMVPLPGIYDPDFIAANQGSRANHVIKGTKKEQMQQVIKDIREFKEANKVDKVVVLWTANTERYSNVIVGLNDTVESLLASLDKNESEISPSTLYALACIYEDVPFINGSPQNTFVPGVIDLAIKRNVLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVMHNTCEDSLLAAPIILDLVLLAELSTRIQLKAAGEGKFHSFHPVATILSYLTKAPLVPPGTPVVNALSKQRSMLENILRACVGLAPENNMILEYK

SEQ ID NO: 880 - protein, 510 aa, Arnica
MFIESFKVESPNVKYTEDEIHSVYNYDTTELVHEEKDGAYQWLVKPKTVKYEFKTQTRLPKLGVMLVGWGGNNGSTLTAGVIANREGISWATKEKVQQANYFGSLTQASTIRVGSFNGEEIYAPFKSLLPMVNPDDIVFGGWDISSMNLADSMARAKVLDIDLQKQLRPYMESMVPVPGIFDPDFIAANQGARADNCIKGTKNEQIQKIIKDIREFKEANKVDKVVVLWTANTERYSNVMFGLNDTMESLFASLDKNEAEISPSTLYAIACILENVPFINGSPQNTFVPGVIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAETEGKFHSFHPVATILSYLTKAPLVPPGTPVVNALAKQRAMLENILRACVGLAPENNMILEYK

SEQ ID NO: 881 - protein, 510 aa, Cirsium
MFIESFKVESPNVKYTSDEIHSLYNYDTTELVHEEKDGAFQWVVKPKTVKYEFKTQTPVPKLGVMLVGWGGNNGSTLTAGVIANREGISWATKDKVQQANYFGSLTQASTIRVGSFNGEEIYAPFKSLLPMVNPDDIVFGGWDISSMNLADSMARARVLDIDLQKQLRPYMESMVPLPGIFDPDFIAANQGSRADNVIKGNKNEQIQKIIKDIREFKEANKVEKVVVLWTANTERYSNVVVGLNDTMENLFASIDKNEAEISPSTLYAIACILENVPFINGSPQNTFVPGVIDLAIQRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSTRIQLKAESEGKFHSFHPVATILSYLTKAPLVPPGTPVVNALAKQRAMLENILRACVGLAPENNMILEYK

SEQ ID NO: 882 - protein, 510 aa, Cleome spinosa
MFIESFKVESPNVKYTENEIHSVYDYETTELVHENVNGAYQWIVKPKTVKYEFKTDVHVPKLGVMLVGWGGNNGSTLTAGVIANREGISWATKDKVQQANYFGSLTQASSIRVGSYNGEEIYAPFKSLLPMVNPDDVVFGGWDISDMNLADAMARARVLDIDLQKQLRPYMESMVPLPGIYDPDFIAANQGSRANSVIKGSKKEQVDQIIKDIREFKEKSKVDKVVVLWTANTERYSNVIAGLNDTMENLLASVDKNESEISPSTLYAIACIFEGVPFINGSPQNTFVPGLIDMAIRRNCLIGGDDFKSGQTKMKSVLVDFLVGAGIKPTSIVSYNHLGNNDGMNLSAPQTFRSKEISKSNVVDDMVASNGILYEPGEHPDHVVVIKYVPYVADSKRAMDEYTSEIFMGGKSTIVMHNTCEDSLLAAPIILDLVLLAELSTRIQLKAEGEGKFHTFHPVATILSYLTKAPLVPPGTPVVNALSKQRAMLENILRACVGLAPENNMILEYK

SEQ ID NO: 883 - protein, 512 aa, Iceplant
MFIESFKVESPNVKYTENEIESVYNYDTTELVHENRKDAGGYQWIVKPKTVQYHFKTDTRVPKLGVMLVGWGGNNGSTLTGGVIANREGISWATKDKIQQANYFGSLTQASSIRVGSFNGEEIYAPFKSLLPMVNPDDVVFGGWDISDMNLADAMTRARVFDIDLQKQLRPYMEHMVPLPGIYDPDFIAANQGSRANNVIKGTKKEQVERVIKDIREFKEKNKVDKVVVLWTGNTERYSNVVVGLNDTMENLLASLEKNESEISPSTLYALACIEENIPFINGSPQNTFVPGLIDLAIKKNSLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGTNTIVMHNTCEDSLLAAPIILDLVLLAELSTRIQLKAEEEDKFHSFHPVATILSYLTKAPLVPPGTPVVNALSKQRAMLENILRACVGLAPENNMILEYK

SEQ ID NO: 884 - protein, 510 aa, Pepper
MFIENFKVESPNVKYTENEIQSVYIYDTTELVHEARNGNYQWIVKPNSVQYQFKTDIHVPKLGVMLVGWGGNNGSTLTGGVIANREGISWATKEKVQQANYFGSLTQASTIRVGSFNGEEIYAPFKSLLPMVNPDDVVFGGWDISNMNLADAMVRAKVFDVDLQKQLRPYMESMVPLPGIYDPDFIAANQEARANNVIKGTKKEQVDQIIKDIREFKEKNKVDKIVVLWTANTERYSNVIVGLNDTMENLLAAVDRNEAEISPSTLHAIACILENVPFINGSPQNTFVPGLIDLAIQRNTLIGGDDFKSGQTKMKSVLVDFLVGAGIKPTSIVSYNHLGNNDGMNLSAPQTFRSKEISKSNVVDDMVASNAILYESGEHPDHVVVIKYVPYVGDSKRAMDEYTSEIFMGGKSTIVMHNTCEDSLLAAPIILDLVLLAELSTRIQLKAEGEGKFHSFHPVATILSYLTKAPLVPPGTPVVNALSKQRAMLENIMRACVGLAPENNMILEYK

SEQ ID NO: 885 - protein, 510 aa, Platanus
MFIEGFKVESPNVKYTDDEIQSVYSYESTELVHENRNGTYQWIVKPKTVQYEFKTDIRVPKLGVMLVGWGGNNGSTLTGGIIANREGISWATKDKVQQANYFGSLTQASSIRVGSFNGEEIYAPFKSLLPMVNPDDIVLGGWDISDMNLADAMARAKVFDIDLQRQLRPYMESMVPLPGVYDPDFIAANQGSRANNVIKGTKKEQLEQIMKDIREFKEANKVDKVVVLWTANTERYSNVVVGLNDTMENLLASLEKNEEEISPSTLYALACIYENVPFINGSPQNTFVPGVIDLAIKSNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVLHNTCEDSLLAAPIILDLVLLAELSTRIQIKAEGEGKFHSFHPVATILSYLTKAPLVPPGTPVVNALSKQRAMLENIMRACVGLAPENNMILEYK

SEQ ID NO: 886 - protein, 510 aa, Valeriana
MFIESFKVDSPNVTYTENEIHSVYNYETTELLHENKNGAYQWTVKPKSVKYEFKTDTHVPKLGVMLVGWGGNNGSTLTAGVIANREGISWATKDKVQQANYFGSLTQASTIRVGSFNGEEIYAPFKSLLPMVNPDDIVFGGWDISDMNLADAMARAKVLDIDLQKQLRSYMESMVPLPGIYDPDFIAANQESRANNVIKGTKKEQVQQVIKDIREFKEANKVDKVVVLWTANTERYSNVIVGLNDTEENLFASLEKDEAEISPSTLFGIACVLENVPFINGSPQNTFVPGLIDLAIRKNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAQGEGKFHSFHPVAVILSYLTKAPLVPPGTPVVNALAKQRSMLENIMRACVGLAPENNMILEYK

SEQ ID NO: 887 - protein, 510 aa, B. rapa, Canola
MFIESFKVESPNVKYTENEIQSVYDYETTEVVHENVNGAYQWIVKPKVVKYDFKTDTRVPKLGVMLVGWGGNNGSTLTAGVIANKEGISWATKDKVQQANYFGSLTQASSIRVGSFNGEEIYAPFKSLVPMVNPDDVVFGGWDISDMNLADAMGRAKVLDIDLQKQLRPYMENIVPLPGIYDPDFIAANQGSRANNVINGTKKEQVDQIIKDMREFKEKNKVDKVVVLWTANTERYSNVVVGLNDTMENLMNSVDRDESEISPSTLYAIACVLEGIPFINGSPQNTFVPGLIDLAIKNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEKEGKFHSFHPVATILSYLTKAPLVPPGTPVVNALSKQRAMLENILRACVGLAPENNMILEYK

SEQ ID NO: 888 - protein, 510 aa, B. rapa, Canola
MFIESFKVESPNVKYTENEIHSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAITKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPPGTPVVNALSKQRAMLENILRACVGLAPENNMILEYK

SEQ ID NO: 889 - protein, 510 aa, Oil palm
MFIEKFKVESPNVKYGEHEIESVYHYETTELVHENRDGSYQWIVKPKTVRFDFKTDTRVPKLGVMLAGWGGNNGATLTAGVIANREGISWATKDKVQQANYYGSLTQASTIRVGSFNGEEIYAPFKSLLPMVNPDDIIFGGWDISNMNLADAMARAKVLDIDLQKQLRPYMESMVPLPGIYDPDFIAANQGSRANNVIEGTKKEQVQQIIKDIREFKEKNEVDKVVVLWTANTERYSNVIVGLNDTMENLLASLDRNEAEISPSTLYALACVLENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNGILYGPGEHPDHVIVIKYVPYVGDSKRAMDEYTSEIFMGGRNTIVLHNTCEDSLLAAPIILDLVLLAELSTRIQLKAEGEGKFHSFHPVASILSYLTKAPLVPPGTPVVNALAKQRAMLENILRACIGLSPENNMILEYK

SEQ ID NO: 890 - protein, 510 aa, Canola, Wheat
MFIESFKVESPNVKYTENEIHSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPAGTPVVNALSKQRAMLENILRACVGLAPENNMILEYK

SEQ ID NO: 891 - protein, 510 aa, Dandelion
MFIESFKVESPNVKYTEDEIHSVYNYDTTELVHEEKNGAYQWVVKPKTVKYEFKTQANVPKLGVMLVGWGGNNGSTLTAGVIANREGISWATKDKVQQANYFGSLTQASTIRVGSFNGEEIYAPFKSLLPMVNPDDIVFGGWDISSMNLADSMARARVLDIDLQKQLRPYMESMIPLPGIFDPDFIAANQGSRADNVIKGNKNEQIQKIIKDIREFKEANKVDKVVVLWTANTERYSNVVVGLNDTVENLFASIDKNESEISPSTLYAIACILENVPFINGSPQNTFVPGVIDLAIQKNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSTRIELKSETQGKFHSFHPVATILSYLTKAPLVPPGTPVVNALAKQRAMLENIMRACVGLAPENNMILEYK

SEQ ID NO: 892 - protein, 112 aa, Epimedium
MFIESFKVESPNVKYTENEVQSVYNYETTELVHESRNGVYQWVVKPKTVQYEFKTDTHVPKLGVMLVGWGGNNGSTLTGGVIANRQGISWATKEKYNRLIILAPSLKHRASG

SEQ ID NO: 893 - protein, 510 aa, Euonymus
MFIENFKVESPNVKYTETEIHSVYNYETTELVHENRNGSYQWTVKPKTVKYEFKTDTSVPKLGVMLVGWGGNNGSTLTGGVIANKEGISWATKDKVQQANYFGSLTQASSIRVGSYHGEEVYAPFKSLLPMVNPDEIVFGGWDISDMNLADAMARAKVFDIDLQKQLMPYMEHMVPLPGIYDPDFIAANQDSRANNVIKGTKKEQVQQVIKDIREFKEKTKVDRVVVLWTANTERYSDVIVGLNDTTENLFAALDRDEAEISPSTMYALACILENIPFVNGSPQNTFVPGLIDLAIKRNSLIGGDDFKSGQTKIKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGTNTIVMHNTCEDSLLAAPIILDLVLLAELSSRIQLKAEDEGKFHSFHPVATILSYLTKAPLVPPGTPVVNALSKQRAMLENIMRACVGLAPENNMILEYK

SEQ ID NO: 894 - protein, 510 aa, Euphorbia
MFIEKFQVESPNVKYTNDEVHSVYNYETTELVHESRNGTYQWIVKPKTVKYQFKTDLNVPKLGVMLVGWGGNNGCTLTGGVIANKEGISWATKDKVQQANYFGSLTQASSIRVGSFNGEEIYAPFKSLLPMVNPDDIVFGGWDISDMNLADAMARARVFEIDLQKQLRPYMESMVPLPGIYDPDFIAANQGSRANNVIKGTKKEQVEQIRKDIREFKEKTKVDRVVVLWTANTERYSNVAVGLNDTMENLLASVDKNEAEISPSTLYALACIYEDIPFINGSPQNTFVPGLIDLAIMRNCLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKSTIVLHNTCEDSLLAAPIILDLVLLAELSTRIQLKADGEGKFHSFHPVATILSYLTKAPLVPPGTPVVNALSKQRAMLENILRACVGLAPENNMILEYK

SEQ ID NO: 895 - protein, 510 aa, Lettuce
MFIESFKVESPNVKYAEDEIHSLYNYDTTELIHEEKNGAYQWVVKPKTVKYEFKTQTHVPKLGVMLVGWGGNNGSTLTAGVIANREGISWATKDKVQQANYFGSLTQASTIRVGSFNGEEIYAPFKSLLPMVNPDDIVFGGWDISSMNLADSMARARVLDIDLQKQLRPYMESMVPLPGIFDPDFIAANQGSRADNVIKGNKNEQIQKIIKDIREFKEANKVDKVVVLWTANTERYSNVVVGLNDTVENLFKSIDKNESEISPSTLYAIACILENVPFINGSPQNTFVPGVIDLAISKNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSTRIQLKAETEGKFHSFHPVATILSYLTKAPLVPPGTPVVNALAKQRAMLENIMRACVGLAPENNMILEYK

SEQ ID NO: 896 - protein, 510 aa, Poplar
MFIEKFKVESPNVKYIEDEIHSVYNYETTELVHENRNGSYQWTVKPKTVQYEFKTDIRVPKLGVMLVGWGGNNGSTLTGGVIANKEGISWATKDKVQQANYFGSLTQASSIRLGSFNGEEIYAPFKSLLPMVNPDDIVFGGWDISDMNLADAMARAKVFDIDLQKQLRPYMESMVPLPGIYDPDFIAANQGSRANNVIKGTKKEQLQKIMEDIREFKEANKVDKVVVLWTANTERYSNIVVGLNDTMENLLAAVEKDESEISPSTLFALACINENIPFINGSPQNTFVPGLIDLAIKRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGQNTIVMHNTCEDSLLAAPIILDLVLLAELSTRIQFKGEAEGKFHSFHPVATILSYLTKAPLVPPGTPVVNALSKQRAMLENILRACVGLAPENNMILEYK

SEQ ID NO: 897 - protein, 510 aa, Radish
  misc_feature (36)..(36): Xaa can be any naturally occurring amino acid
  misc_feature (41)..(41): Xaa can be any naturally occurring amino acid
  misc_feature (52)..(52): Xaa can be any naturally occurring amino acid
MFIESFKVESPNVKYTENEIHSVYDYETTEVVHENXNGTYXWVVKPKTVKYXFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPPGTPVVNALSKQRAMLENILRACVGLAPENNMILEYK

SEQ ID NO: 898 - protein, 510 aa, Tragopogon
MFIESFKVESSNVKYTENEIQSLYNYDTTELVHEEKDGAYQWVVRPKTVKYEFKTQTNVPKLGVMLVGWGGNNGSTLTAGVIANREGISWATKDKVQQANYFGSLTQASTIRVGSFNGEEIYAPFKSLLPMVNPDDIVFGGWDISSMNLADSMARARVLDIDLQKQLRPYMESMVPLPGIFDPDFIAANQGSRADNIIKGTKNEQIQKIIKDIREFKEANKVDKVVVLWTANTERYSNVVVGLNDTVENLFASIDKNESEISPSTLYAIACILENVPFINGSPQNTFVPGVIDLAIKKNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVLHNTCEDSLLAAPIILDLVLLAELSTRIQLKSETEGKFHSFHPVATILSYLTKAPLVPPGTPVVNALAKQRAMLENIMRACVGLAPENNMILEYK

SEQ ID NO: 899 - protein, 510 aa, B. juncea
MFIESFKVESPNVKYTENEIQSVYDYETTEVVHENVNGAYQWIVKPKVVKYDFKTDTRVPKLGVMLVGWGGNNGSTLTAGVIANKEGISWATKDKVQQANYFGSLTQASSIRVGSFNGEEIYAPFKSLVPMVNPDDVVFGGWDISDMNLADAMGRAKVLDIDLQKQLRPYMENIVPLPGIFDPDFIAANQGSRANNVIKGTKKEQVDQIIKDMREFKEKNKVDKVVVLWTANTERYSNVIVGLNDTMENLMNSVDRDESEISPSTLYAIACVLEGIPFINGSPQNTFVPGLIDLAIKNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEKEGKFHSFHPVATILSYLTKAPLVPPGTPVVNALSKQRAMLENILRACVGLAPENNMILEYK

SEQ ID NO: 900 - protein, 510 aa, Canola
MFIESFKVESPNVKYTENEIHSVYDYETTEVVHENVNGAYQWIVKPKVVKYDFKTDTRVPKLGVMLVGWGGNNGSTLTAGVIANKEGISWATKDKVQQANYFGSLTQASSIRVGSFNGEEIYAPFKSLVPMVNPDDVVFGGWDISDMNLADAMGRAKVLDIDLQKQLRPYMENIVPLPGIYDPDFIAANQGSRANNVIKGTKKEQVDQIIKDMREFKEKNKVDKVVVLWTANTERYSNVIVGLNDTMENLMNSVDRDESEISPSTLYAIACVLEGIPFINGSPQNTFVPGLIDLAIKNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEKEGKFHSFHPVATILSYLTKAPLVPPGTPVVNALSKQRAMLENILRACVGLAPENNMILEYK

SEQ ID NO: 901 - protein, 510 aa, Euonymus
MFIENFKVESPNVKYTETEIHSVYNYETTELVHENRNGSYQWTVKPKTVKYEFKTDTSVPKLGVMLVGWGGNNGSTLTGGVIANKEGISWATKDKVQQANYFGSLTQASSIRVGSYHGEEVYAPFKSLLPMVNPDEIVFGGWDISDMNLADAMARAKVFDIDLQKQLMPYMEHMVPLPGIYDPDFIAANQDSRANNVIKGTKKEQVQQVIKDIREFKEKTKVDRVVVLWTANTERYSDVIVGLNDTTENLFAALDRDEAEISPSTMYALACILENIPFVNGSPQNTFVPGLVDLAIKRNSLIGGDDFKSGQTKIKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGTNTIVMHNTCEDSLLAAPIILDLVLLAELSSRIQLKAEDEGKFHSFHPVATILSYLTKAPLVPPGTPVVNALSKQRAMLENIMRACVGLAPENNMILEYK

SEQ ID NO: 902 - protein, 510 aa, Strawberry
MFIESFKVESPNVEYTENEIHSVYTYETTELVHENRKGTYQWIVKPKSVKYEFKTDVHVPKLGVMLVGWGGNNGSTLTAGVIANREGISWATKDKVQQANYFGSLTQASSIRVGSFNGEEIYAPFKSLLPMVNPDDIVFGGWDISDMNLADAMARARVLDIDLQKQLRPYMESMIPLPGIYDPDFIAANQGSRANNVIKGTKQEQVQQIIKDIREFKEKNKVDKVVVLWTANTERYSSVIEGLNDTVENLLGSVEKNEAEISPSTLYAIACVMENVPFINGSPQNTFVPGLIDLAIRRNTLIGGDDFKSGQTKMKSVLVDFLVGAGIKPTSIVSYNHLGNNDGMNLSAPQTFRSKEISKSNVVDDMVSSNGILFEPGEHPDHVVVIKYVPYVADSKRAMDEYTSEIFLGGRNTIVMHNTCEDSLLAAPIILDLVLLAELSTRIQLKSEAEAKFHSFHPVATILSYLTKAPLVPPGTPVVNALSKQRAMLENILRACVGLAPENNMILEYK

SEQ ID NO: 903 - protein, 510 aa, Thellungiella parvulum
MFIESFKVESPNVKYTENEIQSVYDYETTEVVHENINGTYQWIVKPKVVKYDFKTDTRVPNLGVMLVGWGGNNGSTLTAGVIANKEGISWATKDKVQQANYFGSLTQASSIRVGSFNGEEIYAPFKSLLPMVNPDDVVFGGWDISDMNLADAMGRAKVLDIDLQKQLRPYMENIVPLPGIYDPDFIAANQGSRANNVIKGTKKEQVDHIIKDMREFKEKNKVDKVVVLWTANTERYSDVIVGLNDTMENLMNSVDRDESEISPSTLYAIACVLEGIPFINGSPQNTFVPGLIDLAIKNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVVNALSKQRAMLENILRACVGLAPENNMILEYK

SEQ ID NO: 904 - protein, 510 aa, Thellungiella parvulum
MFIESFKVESPNVKYTENEIHSVYDYQTTELVHESKNGAYQWIVKPKTVKYEFKTDTHVPKLGVMLVGWGGNNGSTLTAGVIANREGISWATKEKVQQANYFGSLTQASSIRVGSFNGEEIYAPFKSLLPMVNPEEIVFGGWDISDMNLADAMARAKVLDIDLQKQLRPFMEHMVPLPGIYDPDFIAANQGSRANHLIKGTKKQQLEQVIKDIRDFKEKNKVDKVVVLWTANTERYSNVVAGLNDTTENLMSSLDNNESEISPSTLYAIACVIENVPFINGSPQNTFVPGLIELAIKRNSLIGGDDFKSGQTKMKSVLVDFLVGAGIKPTSIVSYNHLGNNDGMNLSAPQTFRSKEISKSNVVDDMVASNGILYESGEHPDHVVVIKYVPYVGDSKRAMDEYTSEIFMGGKNTIVMHNTCEDSLLAAPIILDLVLLAELTTRIEFKAETEGKFHSFHPVATILSYLSKAPLVPPGTPVVNALSKQRAMLENILRACVGLAPENNMILEYK

SEQ ID NO: 905 - protein, 61 aa, Cucumber
MFIDSFKVESPNVTYSDHEIHSIYNYETTELLHENRNGTYHGLSNPNPFNINSRLIFVSPN

SEQ ID NO: 906 - protein, 446 aa, Thellungiella halophilum
MLVGWGGNNGSTLTAGVIANKEGISWATKDKVQQANYFGSLTQASSIRVGSYNGEEIYAPFKSLLPMVNPDDVVFGGWDISDMNLADAMGRAKVLDIDLQKQLRPYMENIVPLPGIYDPDFIAANQGSRANNVIKGTKKEQVDRIIKDMREFKEKNKVDKVVVLWTANTERYSNVIVGLNDTMENLMNSVDRDESEISPSTLYAIACVLEGIPFINGSPQNTFVPGLIDLAIKNNVLIGGDDFKSGQTKMKSVLVDFLVGAGIKPTSIVSYNHLGNNDGMNLSVPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVVNALSKQRAMLENIMRACVGLAPENNMILEYK

SEQ ID NO: 907 - protein, 510 aa, Eschscholzia
MFIESFKVESPNVKYTENTIHSVYNYETTQLVHENKNGAYQWTVKPKTVKYEFNTDTNVPKLGVMLVGWGGNNGSTLTGGLIANREGISWATKDKVQQANYFGSLTQASTIRVGSFNGEEIYAPFKSLLPMVNPDDIVLGGWDISDMNLADAMARAKVFDIDLQKQLRPYMESLVPLPGIYDPDFIAANQGSRANNIIKGTKKEQVQEIIKHMREFKEANKVDKVVVLWTANTERYSNVIVGLNDTTENLLASLERNESEISPSTLYALACIYENIPFINGSPQNTFVPGLIDLAIKHNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVMHNTCEDSLLAAPIILDLVLLAELTTRIQLKSEAEDKFHSFHPVATILSYLTKAPLVPPGTPVVNALSKQRAMLENIMRACVGLAPENNMILEYK

SEQ ID NO: 908 - protein, 510 aa, Primula
MFIESFKVESPNVKYTEDEIHSVYNYETTELVHESRNGSYQWIVKPKSIGYQFKTLTRVPKLGVMLVGWGGNNGSTLTAGVIANREGISWATKDKVQQANYWGSLTQASAIRVGSFNGEEIYAPFKSLLPMVNPDDVVFGGWDISDMNLADSMARARVLDIDLQKQLRPYMEHMVPLPGIFNPDFIAANQGSRANHVIKGTKQEQLQQVIKDIREFKEKSKVDKVVVLWTANTERYSNVIVGLNDTMENLMASVDKNEAEISPSTLYAIACVLENVPFINGSPQNTFVPGLIELAIQRNTLIGGDDFKSGQTKIKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGTNTIVMHNTCEDSLLAAPIILDLVLLAELSTRIQLKAEGEGKFHSFHPVSVILSYLTKAPLVPPGTPVVNALSKQRAMLENILRACVGLSPENNMILEYK

SEQ ID NO: 909 - protein, 510 aa, Amorphophallus
MFIEKFRVESPNVKYGAHEIESVYSYETTELVHELRDGSYQWVVKPKSVRYQFKTDTRVPKLGVMLVGWGGNNGATLTAGVIANREGISWVTKDKIQQANYFGSLTQASTIRVGSFNGEEIYAPFKSLLPMVNPDDIVFGGWDISNMNLADAMARAKVLDIDLQKQLRPYMEAMVPLPGIYDPDFIAANQGSRANNVVKGSKKEQVQQVIKDIREFKEREKVDQVVVLWTANTERYSNVVVGLNDTTDNLLAALDRDEAEISPSTLYALACVLENVPFINGSPQNTFVPGLIDLAIKKNSMIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVLHNTCEDSLLAAPIILDLVLLAELSTRIQLKAEGEGKFHSFHPVAAILSYLTKAPLVPPGTPVVNALSKQRAMLENILRACIGLAPENNMILEYK

SEQ ID NO: 910 - protein, 510 aa, Arabidopsis lyrata
MFIESFKVESPNVKYTENEIHSVYDYQTTELVHENKNGAFQWTVKPKTVKYEFKTDTHVPKLGVMLVGWGGNNGSTLTAGVIANREGISWATKEKVQQANYFGSLTQASSIRVGSFNGEEIYAPFKSLLPMVNPEEIVFGGWDISDMNLADAMARAKVLDIDLQKQLRPLMEHMVPLPGIFDPDFIAANQGSRANHVIKGTKKQQLEQVIKDIREFKEKNKVDKVVVLWTANTERYSNVVVGLNDTTENLMSSLEKDEAEISPSTLYAIACVLENVPFINGSPQNTFVPGLIELAIERNCLIGGDDFKSGQTKMKSVLVDFLVGAGIKPTSIVSYNHLGNNDGMNLSAPQTFRSKEISKSNVVDDMVGSNGILYEPGEHPDHVVVIKYVPYVGDSKRAMDEYTSEIFMGGKNTIVMHNTCEDSLLAAPIILDLVLLAELTTRIQFMAETEGKFHSFHPVATLLSYLSKAPLVPPGTPVVNALSKQRAMLENILRACVGLAPENNMILEYK

SEQ ID NO: 911 - protein, 509 aa, Beet
MFIDNFKVESPNVTYTENEIHSVYNYETTELVHENRKGCGYQWIVKPKSVKYEFKTDTHVPKLGVMLVGWGGNNGCTLTGGVIANREGISWATKDKIQQANYFGSLTQASSIRVGSFNGEEIYAPFKSLLPMVNPDDIVFGGWDISDMNLADAMTRAKVLDIDLQKQLRPYMEHMIPLPGIYDPDFIAANQDSRANNIIKGTKKEQVEQVIKDIREFKEKNKVDKVVVLWTANTERYSNVVEGLNGTTENLLASVERNESEISPSTLFALACVLENIPFINGSPQNTFVPGLIELATKNNSLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGKNTIVLHNTCEDSLLAAPIILDLVLLAELSTRIEFKAETEDKFHSFHPVATILSYLTKAPLVPPGTPVVNALSKQRAMLENIMRACVGLAPENNMILE

SEQ ID NO: 912 - protein, 510 aa, Chelidonium
MFIENFKVESPNVKYSENEVESVYFYETTELVHENKNGTYQWTVKPKTVKYEFKTDTKVPKLGVMLVGWGGNNGSTLTGGIIANREGISWATKDKVQQANYFGSLTQASTIRVGSFNGEEIYAPFKSLLPMVNPDDIVLGGWDISDMNLADSMSRARVFDIDLQKQLRPYMESMVPLPGVYDPDFIAANQGSRANNVIKGTKKEQLQQIIKDIREFKETNKVDKVVVLWTANTERYSNVIVGLNDTTENLLASLEKNESEISPSTLYALACIYENVPFINGSPQNTFVPGVIDLAIKHNTLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVMHNTCEDSLLAAPIILDLVLLAELSTRIQLKSEAEEKYHSFHPVATILSYLTKAPLVPPGTPVVNALSKQRAMLENIMRACVGLAPENNMILEYK

SEQ ID NO: 913 - protein, 510 aa, Eucalyptus
MFIESFKVDSPNVTYGDAEIHSVYDYQTTELVHENRNGAYQWTVKPKSVKYEFKTDTRVPKLGVMLVGWGGNNGSTLTGGVIANREGISWATKDNVQQANYFGSLTQASTIRVGSYNGEEIHAPFKSLLPMVNPDDIVIGGWDISKMNLADAMARARVFDIDLQKQLRPYMEHMVPLPGIYDPDFIAANQEARANNVIKGSKKEQVQQIIKDMRDFKEKNKVDKVVVLWTANTERYSNVVVGLNDTMENLMNSMEKNESEISPSTLYAIACVLENIPFINGSPQNTFVPGLIDLAIQRNVLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALAKQRAMLENIMRACVGLAPENNMILEYK

SEQ ID NO: 914 - protein, 510 aa, Arabidopsis
MFIESFKVESPNVKYTENEIHSVYDYQTTELVHENKNGAFQWTVKPKTVKYEFKTDTHVPKLGVMLVGWGGNNGSTLTAGVIANREGISWATKEKVQQANYFGSLTQASSIRVGSFNGEEIYAPFKSLLPMVNPEEIVFGGWDISDMNLADAMARAKVLDIDLQKQMRPFMEHMVPLPGIFDPDFIAANQGSRANHVIKGTKKQQLEQVIKDIREFKEKNKVDKVVVLWTANTERYSNVVVGLNDTTENLMSSLDKDEAEISPSTLYAIACVLENVPFINGSPQNTFVPGLIELAIKRNCLIGGDDFKSGQTKMKSVLVDFLVGAGIKPTSIVSYNHLGNNDGMNLSAPQTFRSKEISKSNVVDDMVGSNGILYEPGEHPDHVVVIKYVPCVGDSKRAMDEYTSEIFMGGKNTIVMHNTCEDSLLAAPIILDLVLLAELTTRIQFMSENEGKFHSFHPVATLLSYLSKAPLVPPGTPVVNALSKQRAMLENVLRACVGLAPENNMILEYK

SEQ ID NO: 915 - protein, 510 aa, B. rapa
MFIESFKVESPNVKYTENEIHSVYDYETTEVVHENRNGSYQWIVKPKTVQYDFKTDTRVPKLGVMLVGWGGNNGSTLTAGVIANKEGISWATKDGVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIEGTKKEQVDHIIKDMREFKEKNKVDKVVVLWTANTERYSDVVVGLNDTMENLLASVEKSESEISPSTLYAIACVLEGVPFINGSPQNTFVPGLIELAISRNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKAKGEGKYHSFHPVATILSYLTKAPLVPPGTPVVNALSKQRAMLENILRACVGLAPENNMILEYK

SEQ ID NO: 916 - protein, 510 aa, B. rapa
MFIESFKVESPKVKYTENEIHSVYDYQTTELVHESKNGAYQWTVKPKTVKYEFKTDTHVPKLGVMLVGWGGNNGSTLTAGVIANREGISWATKEKVQQANYFGSLTQASSIRVGSFNGEEIYAPFKSLLPMVNPEEIVFGGWDISDMNLADAMGRAKVLDIDLQKQLRPFMEHMVPLPGIYDPDFIAANQGSRANHLIKGTKKEQLEQVIKDIRDFKEKNKVDKVVVLWTANTERYSNVVAGLNDTTENLMSSLDKNEAEISPSTLYAIACVLENVPFINGSPQNTFVPGLIELAIKRNSLIGGDDFKSGQTKMKSVLVDFLVGAGIKPTSIVSYNHLGNNDGMNLSAPQTFRSKEISKSNVVDDMVASNGILFDSGEHPDHVVVIKYVPYVGDSKRAMDEYTSEIFMGGKNTIVMHNTCEDSLLAAPIILDLVLLAELTTRIELKADNEGKFHSFHPVATLLSYLSKAPLVPPGTPVVNALSKQRAMLENILRACVGLAPENNMILEYK

SEQ ID NO: 917 - protein, 510 aa, Millet
MFIESFRVESPNVRYGPSEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADSMTRAKVLDIDLQKQLRPYMESMVPLPGIYDPDFIAANQGSRANNVIKGTKKEQVDQIIKDIREFKEKNKVDKVVVLWTANTERYSNVCAGLNDTVENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 918 - protein, 510 aa, Phalaenopsis
MFVESFKVESPNVKYGEQEIHSIYNYETTELVHESRNGSYAWIVKPKTVQYEFKTDTLVPKLGVMLVGWGGNNGSTLTAAVIANREGISWATKDNVQQANYFGSLTQASTIRIGSYNGEEIYAPFKSLLPMVNPDEIVFGGWDISNLNLADSMTRARVLDIDLQKQLRPYMESMVPLPGIYDPDFIAANQDSRANNVIKGTKSEQVQQVIKDIREFKDKNNVDKVVVLWTANTERYSDVMVGLNDTTENLLASLERNETEISPSTLYAIACVMENIPFINGSPQNTFVPGLIDFAIQRNSLIGGDDFKSGQTKMKSVLVDFLVGAGIKPTSIVSYNHLGNNDGMNLSAPQTFRSKEISKSNVVDDMVTSNGILYQPGEHPDHVVVIKYVPYVGDSKRAMDEYTSEIFMGGKNTIVLHNTCEDSLLAAPIILDLVLLAELSSRIQFKAEGEGKFHSFHPVATILSYLTKAPLVPPGTPVVNALSKQRAMLENILRACIGLAPENNMILEYK

SEQ ID NO: 919 - protein, 511 aa, Silene
MFIENFKVESPNVEYSDGEIRSVYDYQTTELVHENRKGSGYQWIVKPKSVKYQFKTDTRVPKLGVMLVGWGGNNGCTLTGGVIANREGISWATKDKIQQANYFGSLTQASSIRVGSFNGEEIYAPFKSLLPMVNPDDIVFGGWDISNLNLADAMTRAKVLDIDLQKQLRPYMEHMVPLPGIYDPDFIAANQDSRANNIIKGTKKEQVDQVIKDIREFKEKNKVDKVVVLWTGNTERYSNVQVGLNDTMENFLASVEKNESEISPSTLYALACILENVPFINGSPQNTFVPGLIDLAIKNNSLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQLKAENEEKFHSFHPVATILSYLTKAPLVPPGTPVVNALSKQRAMLENIMRACVGLAPENNMILEYK

SEQ ID NO: 920 - protein, 510 aa, Sorghum, Sugarcane
MFIESFRVESPHVRYGPTEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDLVFGGWDISNMNLADSMTRAKVLDIDLQKQLRPYMESMVPLPGIYDPDFIAANQGSRANNVIKGTKKEQVEQIIKDIREFKEKNKVDKIVVLWTANTERYSNVCTGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 921 - protein, 510 aa, Switchgrass
MFIESFRVESPNVRYGPSEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMESMVPLPGIYDPDFIAANQGSRANNVIKGTKKEQVDQIIKDIREFKEKNKVDKVVVLWTANTERYSNVCAGLNDTVENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACIGLAPENNMILEYK

SEQ ID NO: 922 - protein, 510 aa, Thellungiella halophilum
MFIESFKVESPNVKYTENEIHSVYDYETTEVVHENRNGTYQWIVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMIPLPGIYNPDFIAANQGSRANNVIKGTKKEQVDHIIKDMREFKEKNKVDKLVVLWTANTERYSDVIVGLNDTMENLMASVEKDESEISPSTLYAIACVLEGIPFINGSPQNTFVPGLIELAISRNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 923 - protein, 462 aa, Amborella
MFIESFRVESPNVKYTEDKIESVYEYETTEVVHENRNGKYEWVVKPKTVKYHFNTDTRVPKLGVMLVGWGGNNGSTITAGVIANREGISWATKDKVQQANYFGSLTQASTIRVGSFNGEEMYAPFKSLLPMVNPDDIVLGGWDISDMNLADSMARAKVLDIDLQRQLRPYMESMVPLPGIYDPDFIAANQGSRANNVIKGTKKEQVQKIINDIREFKETNKVDMVVVLWTANTERYSDVVEGLNDTMENLLAAVDRNEAEISPSTLHAMACVLENVPFINGSPQNTFVPGLIELAIKTNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVLHNTCEDSLLAAPIILDLVLLAELSTRIQLKAHEGEVPLLPPGCHHP

SEQ ID NO: 924 - protein, 249 aa, Thellungiella halophilum
MFIESFKVDSPNVKYTENEIHSVYDYQTTELVHENKNGAYQWTVKPKTVKYEFKTNTHVPKLGVMLVGWGGNNGSTLTAGVIANREGISWATKEKVQQANYFGSLTQASSIRVGSFNGEEIYAPFKSLLPMVNPAEIVFGGWDISDMNLADAMARGKVLDIDLQKQLRPFMEHMVPLPGIYDPDFIAANQGSRANHLIKGTKKQQLEQVIKDIRDFKEKNTVDRVVVLWTRTQKDTAMCWLVLTTRRRI

SEQ ID NO: 925 - protein, 510 aa, Arabidopsis
MFIESFKVESPNVKYTENEINSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPEDVVFGGWDISDMNLADAMARARVLDIDLQKQLRPYMENMIPLPGIYDPDFIAANQGSRANSVIKGTKKEQVDHIIKDMREFKEKNKVDKLVVLWTANTERYSNVIVGLNDTTENLLASVEKDESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGRNTIVLHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 926 - protein, 510 aa, Canola
MFIESFKVESPNVKYTENEIHSVYDYETTEVVHENRNGSYQWIVKPKTVQYDFKTDTRVPTLGVMLVGWGGNNGSTLTAGVIANKEGISWATKDGVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDHIIKDMREFKEKNKVDKVVVLWTANTERYSDVVVGLNDTMENLLASVEKNESEISPSTLYAIACVLEGVPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKAKGEGKYHSFHPVATILSYLTKAPLVPPGTPVVNALSKQRAMLENILRACVGLAPENNMILEYK

SEQ ID NO: 927 - protein, 510 aa, Foxtail_millet
MFIESFRVESPNVRYGPSEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADSMTRAKVLDIDLQKQLRPYMESMVPLPGIYDPDFIAANQGSRANNVIKGTKKEQVDQIIKDIREFKEKNKVDKIVVLWTANTERYSNVCAGLNDTVENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 928 - protein, 510 aa, Nasturtium
MFIESFKVESPNVNYSENEIHSVYDYQTTDLVHENRNGTYQWIVKPKSVKYEFKTDTRVPKLGVMLVGWGGNNGSTLTAGVTANREGISWATKEKVQRANYFGSLTQASTIRVGSFNGEEIHAPFKSLLPMVNPDDIVFGGWDISDMNMADAMARAKVLDIDLQKQLRPYMEHLVPLPGIYEPDFIAANQGSRANNVIKGTKKEQVQQIIKDISEFKEKNKVDKVVVLWTANTERYSSVVVGLNDTMENLLASLEKNEEEISPSTLYAIACVLENIPFINGSPQNTFVPGLIDLAIKKNSLIGGDDFKSGQTKMKSVLVDFLVSAGIKPTSIVSYNHLGNNDGMNLSAPQTFRSKEISKSNVVDDMVSSNAILYEPGEHPDHVVVIKYVPYVGDSKRAMDEYTSEIFLGGKSTIVMHNTCEDSLLAAPIILDLVLLAELSTRIQLKAEQEGKFHPFHPVATLLSYLSKAPLVPPGTPVVNALSKQRSMLENIMRACVGLAPENNMILEYK

SEQ ID NO: 929 - protein, 510 aa, Phalaenopsis
MFVESFKVESPNVKYGEQEIHSIYNYETTELVHESRNGSYAWIVKPKTVQYEFKTDTLVPKLGVMLVGWGGNNGSTLTAAVIANREGISWATKDNVQQANYFGSLTQASTIRIGSYNGEEIYAPFKSLLPMVNPDEIVFGGWDISNLNLADSMTRARVLDIDLQKQLRPYMESMVPLPGIYDPDFIAANQDSRANNVIKGTKSEQVQQVIKDIREFKDKNNVDKVVVLWTANTERYSDVMVGLNDTTENLLASLERNETEISPSTLYAIACVMENIPFINGSPQNTFVPGLIDFAIQRNSLIGGDDFKSGQTKMKSVLVDFLVGAGIKPTSIVSYNHLGNNDGMNLSAPQTFRSKEISKSNVVDDMVTSNGILYQPGEHPDHVVVIKYVPYVGDSKRAMDEYTSEIFMGGKNTIVIHNTCEDSLLAAPIILDLVLLAELSSRIQFKAEGEGKFHSFHPVATILSYLTKAPLVPPGTPVVNALSKQRAMLENILRACIGLAPENNMILEYK

SEQ ID NO: 930 - protein, 510 aa, Poppy
MFIENFKVESPNVKYTEEGIESVYNYETTELIHENKNGAYQWTVKPKSVQYQFKTDTKVPKLGVMLVGWGGNNGSTLTGGMIANKEGISWATKDKVQQANYFGSLTQASTIRVGSFNGEEIYAPFKSLLPMVNPDDIVLGGWDISDMNLADAMSRARVFDIDLQKQLRPYMESMVPLPGIYDPDFIAANQGSRANNIIKGTKKEQVQQIIKDIREFKEANKVDKVVVLWTANTERYSNVIVGLNDTEESLVASVEKNEAEISPSTLYALACIYENIPFINGSPQNTFVPGLIDLAIKHNTLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVMHNTCEDSLLAAPIILDLVLLAELSTRIQLKSEKEGKFHSFHPVSTILSYLTKAPLVPPGTPVVNALSKQRAMLENIMRACVGLAPENNMILEYK

SEQ ID NO: 931 - protein, 510 aa, Radish
MFIESFKVESPNVKYTENEIHSVYDYETTEVVHENVNGAYQWIVKPKVVKYDFKTDTRVPKLGVMLVGWGGNNGSTLTAGVIANKEGISWATKDKVQQANYFGSLTQASSIRVGSFNGEEIYAPFKSLVPMVNPDDVVFGGWDISDMNLADAMGRAKVLDIDLQKQLRPFMENIVPLPGIFDPDFVAANQGSRANNVIKGTKKEQVDQIIKDMREFKEKNKVDKVVVLWTGNTERYSNVIVGLNDTMENLMKSVERDESEISPSTLYAIACVLEGIPFINGSPQNTFVPGLIDLAIKNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEKEGKFHSFHPVATILSYLTKAPLVPPGTPVVNALSKQRAMLENILRACVGLAPENNMILEYK

SEQ ID NO: 932 - protein, 510 aa, Switchgrass
MFIESFRVESPNVRYGPSEIESEYRYDTTELVHEGKDGASRWVVRPKSVKYHFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMESMVPLPGIYDPDFIAANQGSRANNVIKGTKKEQVDQIIKDIREFKEKNKVDKVVVLWTANTERYSNVCTGLNDTVENLLKSVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 933 - protein, 510 aa, Wheat
MFIESFRVESPNVRYGAGEIESEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 934 - protein, 510 aa, Wheat
MFIESFRVESPNVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 935 - protein, 380 aa, Cleome gynandra
MVNPDDVVFGGWDISDMNLADAMARARVLDIDLQKQLRPYMENIVPLPGIYDPDFIAANQGSRANNVVKGCKKEQVDQIIKDIREFKEKNKVDKVVVLWTANTERYSNVIVGLNDTMENLLASVDKNESEISPSTLYGIACVMEGVPFINGSPQNTFVPGLIDMAIRRNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFLGGKNTIVMHNTCEDSLLAAPIILDLVLLAELSTRIQLKAEGEGKFHSFHPVATILSYLTKAPLVPPGTPVVNALSKQRAMLENIMRACVGLSPENNMILEYK

SEQ ID NO: 936 - protein, 304 aa, Onion
  misc_feature (208)..(208): Xaa can be any naturally occurring amino acid
  misc_feature (303)..(303): Xaa can be any naturally occurring amino acid
MFIENFKVESPNVKYGEDEIESIYNYETTELVHESRNGSYQWIVKPKTVQYNFKTDVHVPKLGVMLVGWGGNNGSTLTAGVIANREGISWATKDKIQRANYFGSLTQASAIRVGSFNGEEIYAPFKSLLPMVNPDDIVFGGWDISNMNMADAMARAKVLDIDLQKQLRPYMESMVPLPGIFDPDFIASNQGARANHTIKGTKKEQVQXIIKDMREFKEKNKVDKIVVLWTANTERYSNVVVGLNDTMKNLMASLEKDEHEISPSTLYGIACVMENVPYINGSPQNTFVPGLIEMAIQRNCLIXW

SEQ ID NO: 937 - protein, 242 aa, Petunia
MFIENFKVESPNVKYTESEIHSLYDYETTELVHEERNGTYQWIVKPKTVKYEFKTDTHVPKLGVMLVGWGGNNGSTLTGGVIANREGISWATKEKVQQANYFGSLTQASTIRVGSFNGEEIYAPFKSLLPMVNPDDVVFGGWDISNMNLADAMVRAKVFDIDLQNQLRPYMESMVPLPGIYDPDFIAANQESRANNVIKGTKKEQVDQIIKDIREFKEKNKVDKVVVLWTAIQKEQQCGWWS

SEQ ID NO: 938 - protein, 510 aa, Maize
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 939 - protein, 510 aa, Poppy
MFIENFKVESPNLKYTEEGIESVYNYETTELIHENKNGAYQWTVKPKSVQYQFKTDTKVPKLGVMLVGWGGNNGSTLTGGMIANKEGISWATKDKVQQANYFGSLTQASTIRVGSFNGEEIYAPFKSLLPMVNPDDIVLGGWDISDMNLADAMSRARVFDIDLQKQLRPYMESMVPLPGIYDPDFIAANQGSRANNIIKGTKKEQVQQIIKDIREFKEANKVDKVVVLWTANTERYSNVIVGLNDTEESLLASVEKNEAEISPSTLYALACIYENIPFINGSPQNTFVPGLIDLAIKHNTLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIVMHNTCEDSLLAAPIILDLVLLAELSTRIQLKSEKEGKFHSFHPVSTILSYLTKAPLVPPGTPVVNALSKQRAMLENIMRACVGLAPENNMILEYK

SEQ ID NO: 940 - protein, 510 aa, Arabidopsis lyrata
MFIESFKVESPNVKYTENEIHSVYDYETTEVVHENRNGTYQWIVKPKSVKYDFITETRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMENMIPLPGIYDPDFIAANQGSRANSVIKGTKKEQVDHIIKDMREFKEKNKVDKLVVLWTANTERYSNVIVGLNDTMENLLASVEKDESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGRNTIVMHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 941 - protein, 510 aa, Brachypodium
MFIESFRVESPNVRYGAGEIEAEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIRDFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 942 - protein, 510 aa, Canola
MFIESFKVESPNVEYTENEIHSVYDYETTEVVHENRNGSYQWIVKPKTIKYDFKTDTRVPKLGVMLVGWGGNNGSTLTAGVIANKEGISWATKDGVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDHIIKDMREFKEKNKVDKLVVLWTANTERYSDVVVGLNDTMENLLASVEKNEAEISPSTLYAIACVLEGIPFINGSPQNTFVPGLIELAISRNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFRAKGEGKYHSFHPVATILSYLTKAPLVPPGTPVVNALSKQRAMLENILRGCVGLAPENNMILEYK

SEQ ID NO: 943 - protein, 510 aa, Rye
MFIESFRVESPNVRYGAGEIESEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDIVFGGWDISSMNLADAMTRAKVLDIDLQKQLRPYMESITPLPGIYDPDFIAANQGSRANNVLKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 944 - protein, 510 aa, Thellungiella parvulum
MFIESFKVESPNVKYTENEIHSVYDYETTQVVHENRNGTYQWIVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMIPLPGIYNPDFIAANQGSRANSVIKGTKKEQVDHIIKDMREFKEKNKVDKLVVLWTANTERYSDVIVGLNDTMENLLASVEKDESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 945 - protein, 511 aa, Arabidopsis lyrata
MFIESFKVESRNVKYTENEIHSVYDYETTEVVHEKTINGSYQWIVKPKTVKYDFKTDIRVPKLGVMLVGWGGNNGSTLTAGVIANKEGISWATKDKVQQANYFGSLTQASSIRVGSFNGEEIYAPFKSLLPMVNPDDVVFGGWDISDMNLADAMARARVLDIDLQKQLRPYMENIVPLPGIYDPDFIAANQGSRANHVIKGTKKEQVDHIIKDMREFKEKNQVDKVVVLWTANTERYSNVVVGMNDTMENLMESVDRDEAEISPSTLYAIACVLEGIPFINGSPQNTFVPGLIDMAIRNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVVNALSKQRAMLENILRACVGLAPENNMIMEFK

SEQ ID NO: 946 - protein, 510 aa, B. juncea
MFIESFRVESPHVRYGAAEIESDYQYDTTELVHESHDGASRWVVRPKSVRYNFRTTTTVPKLGVMLVGWGGNNGSTLTAGVIANREGISWATKDKVQQANYYGSLTQASTIRVGSYNGEEIYAPFKSLLPMVNPDDLVFGGWDISNMNLADAMTRAKVLDIDLQKQLRPYMESMVPLPGIYDPDFIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYKPGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 947 - protein, 511 aa, Arabidopsis
MFIESFKVESPNVKYTENEIHSVYDYETTEVVHEKTVNGTYQWIVKPKTVKYDFKTDIRVPKLGVMLVGLGGNNGSTLTAGVIANKEGISWATKDKVQQANYFGSLTQASSIRVGSFNGEEIYAPFKSLLPMVNPDDVVFGGWDISDMNLADAMARARVLDIDLQKQLRPYMENIVPLPGIFDPDFIAANQGSRANHVIKGTKKEQVDHIIKDMREFKEKNKVDKVVVLWTANTERYSNVVVGMNDTMENLMESVDRDEAEISPSTLYAIACVLEGIPFINGSPQNTFVPGLIDMAIRNNVLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVINALSKQRAMLENIMRACVGLAPENNMIMEFK

SEQ ID NO: 948 - protein, 224 aa, Rye
MFIESFRVESPNVRYGAGEIESEYRYDTTELVHESHDGASKWVVRPKSVNYHFKTNTNVPRLGVMLVGWGGNNGSTLMAGVIANREGISWATKDKVQQANYFGSLTQASTIRVGSYNGEEIYAPFKSLLPMVNPDDIVFGGWDISSMNLADAMTRAKVLDIDLQKQLRPTWSPSRRSPASMTRTSSLPTRAPGLTMSLRVQRKSRWSRLSKTLGSSRRRTRWTK

SEQ ID NO: 949 - protein, 495 aa, Arnica
TENEIHSVYNYDTTELVHEEKNGAYQWVVKPKTVKYEFKTETNVPKLGVMLVGWGGNNGSTLTAGVIANREGISWATKEKIQQANYFGSLTQASTIRVGSFNGEEIYAPFKSLLPMVNPDDIVFGGWDISSMNLADSMARAKVLDIDLQKQLSPYMESMVPLPGIFDPDFIAANQGARADNCIKGTKNEQIQKVIKDIREFKEANKVDKVVVLWTANTERYSNVMVGLNDTMESLFASLDRNEAEISPSTLFAIACILENVPFINGSPQNTFVPGVIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKSETEGKFHSFHPVATILSYLTKAPLVPPGTPVVNALAKQRAMLENILRACVGLAPENNMILEYK

SEQ ID NO: 950 - protein, 510 aa, Barley
MFIESFRVESPKVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQVIKDIREFKEKNKVDKVVVLWTANTERYSNVSVGLNDTTENLLASVDKNEAEISPSTLYAIACVMEGVPFINGSPQNTFVPGLIDLAIKNDCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 951 - protein, 510 aa, Oat
MFIESFRVESPNVRYGAGEIESEYRYDTTELVHESHNGASKWVVRPKSVNYHFKTDTNVPKLGVMLVGWGGNNGSTLMAGVIANREGISWATKDKVQQANYFGSLTQASTIRVGSYNGEEIYAPFKSLLPMVSPDDIVFGGWDISSMNMADAMTRAKVLDIDLQKQLRPYMESIVPLPGIYDPDFIAANQGSRANNVIKGTKKEQMEQVIKDIREFKEKNKVDKVVVLWTANTERYSGVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 952 - protein, 510 aa, Rice
MFIESFRVESPHVRYGAAEIESDYQYDTTELVHESHDGASRWIVRPKSVRYNFRTTTTVPKLGVMLVGWGGNNGSTLTAGVIANREGISWATKDKVQQANYYGSLTQASTIRVGSYNGEEIYAPFKSLLPMVNPDDLVFGGWDISNMNLADAMTRAKVLDIDLQKQLRPYMESMVPLPGIYDPDFIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYELGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 953 - protein, 505 aa, Silene
KVESPNVEYRDGEIHSVYNYQTTELVHENPKGTGYQWTVKPKSVKYEFRTQTHVPKLGVMLVGWGGNNGCTLTGGVIANREGISWATKDKIQQANYFGSLTQASSIRVGSFNGEEIYAPFKSLLPMVNPDDIVFGGWDISNMNLADAMTRARVLDIDLQKQLRPYMEHMVPLPGIYDPDFIAANQDSRANNIIKGTKKEQVDQVIKDIREFKEKTKVDKVVVLWTGNTERYSNVVVGLNDTIENLLAAVDRDESEISPSTLYALACVLEQVPFINGSPQNTFVPGLIDLAIKNNSLIGGDDFKSGQTKIKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGTNTIVMHNTCEDSLLAAPIILDLVLLAELSTRIQLKGEHEDKFHSFHPVATILSYLTKAPLVPPGTPVVNALSKQRAMLENIMRACVGLAPENNMILEYK

SEQ ID NO: 954 - protein, 239 aa, Tomato
MCSKPITLVLLHRPLLFKLGPSMGRRSMLPLRAYFPWLIHPDDVVFGEWDISNMNLADDMARANVFDIDLQKKLRPYMESMVPFPGIYDPDFITANQGSRANNVIKGTKKEQVDQIIKDIRQFKENNKVDKVVVLWTANTERYSSVVVGLNDTMENLFASVDRNEAEISPSTLYAIACILENVPFINGSPQNTFVPGLIDLAIKRNTLIGGDDFKSGQTKMKSVLVYFLVGAGINQHQS

SEQ ID NO: 955 - protein, 510 aa, Maize
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGSRANNVIKGTKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENIMRACVGLAPENNMILEYK

SEQ ID NO: 956 - protein, 510 aa, Oat
MFIESFRVESPNVRYGAGEIESEYRYDTTELVHESHNGASKWVVRPKSVNYHFKTDTNVPKLGVMLVGWGGNNGSTLMAGVIANREGISWATKDKVQQANYFGSLTQASTIRVGSYNGEEIYAPFKSLLPMVSPDDIVFGGWDISSMNMADAMTRAKVLDIDLQKQLRPYMESIVPLPGIYDPDFIAANQGSRANNVIKGTKKEQMEQVIKDIREFKEKNKVDKVVVLWTANTERYSGVSVGLNDTMENLLASVEKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 957 - protein, 509 aa, Rye
MFIESFRVESPNVRYGAGEIESEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDIVFGGWDISSMNLADAMTRAKVLDIDLQKQLRPYMESITPLPGIYDPDFIAANQGSRANNVLKGTKKEQMEQIIKDIREFKEKNKVDKVVVLWTANTERYSNVSVGLNDTMENLLASVDKNEAEISPSTLYAIACVMEGVPFINGASDHFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 958 - protein, 511 aa, Bean
MFIESFKVESPNVKYTENEIHSVYDYETTEVVHEKTVNGTYQWIVKPKTVKYDFKTDIRVPKLGVMLVGLGGNNGSTLTAGVIANKEGISWATKDKVQQANYFGSLTQASSIRVGSFNGEEIYAPFKSLLPMVNPDDVVFGGWDISDMNLADAMARARVLDIDLQKQLRPYMENIVPLPGIFDPDFIAANQGSRANHVIKGTKKEQVDHIIKDMREFKEKNKVDKVVVLWTANTERYSNEVVGMNDTMEDLMESVDRDEAEISPSTLYAIACVLEGIPFINGSPQHTFVPGLIDMAIRNNVLIGGDDFKSGQTKMKSVLGDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVINALSKQRAMLENIMRACVGLAPENNMIMEFK

SEQ ID NO: 959 - protein, 501 aa, Eschscholzia
MFIDNFKVESPNVKYSENEIHSVYNYETTELVHENKNGAYQWTVKPKTVKYEFKTETKVPKLGVMLVGWGGNNGSSLTGGLIANREGISWATKDKVQQANYFGSLTQASTIRVGSFNGEEIYAPFKSLLPLVNPDDIVLGGWDISDMNLADAMARAKVFDIDLQKQLRPYMESMVPLPGIYDPDFIAANQGSRANNIIKGTKKEQVEQIMKDIREFKENSKVDKVVVLWTANTERYSNVIVGLNDNIENLLGSLERNESEISPSTLFALACIYENVPFINGSPQNTFVPGLIDLAMKHNTLIGGDDFKSGQTKMKSVLVDFLVGAGIKPTSIVSYNHLGNNDGMNLSAPQTFRSKEISKSNVVDDMVSSNGILYEAGEHPDHVIVIKYVPYVGDSKRAMDEYTSEIFMGGKSTIVMHNTCEDSLLAAPIILDLVLLAELSTRIQLKSEGEEKFHSFHPVATILSYLTKAPLVPPGTPVVNALSKQRAMLENIMRACVGLAP

SEQ ID NO: 960 - protein, 509 aa, Lolium
MFIESFRVESPNVRYGAGEIQSEYRYDTTELVHESHNGASKWVVRPKSVGYQFRTDTNVPKLGVMLVGLGGNNGSTLMAGVIANREGISWATKDKVQQANYFGSLTQASTIRVGSYNGEEIYAPFKSLLPMVSPDDIVFGGWDISSMNMADAMTRAKVLDIDLQKQLRPYMESIVPLPGIYDPDFIAANQGSRANNVIKGTKKEQMQQIIKDIREFKEKNKVDKVVVLWTANTERYSAVSVGLNDTTENLLASVEKNEAEISPSTLYAIACVMEGVPFVNGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILFEPGEHPDHVVVIKYVPYVGDSKRAMDEYTSEIFMGGKSTIVLHNTCEDSLLAAPIILDLVLLAELSTRIQLKSEGEDKFHSFHPVATILSYLTKAPLVPPGTPVVNALAKQRAMLENIMRACVGLAPENNMILEY

SEQ ID NO: 961 - protein, 485 aa, Tobacco
YQTTELVHEEKNGSYQWTVKPKCVKYEFKTDTNVPKLGVMLVGWGGNNGSTLTGGIIANKEGISWATKEKVQQANYFGSLTQASTIRVGSFNGEEIYAPFKSLLPMVNPDDVVFGGWDISNMNLADAMVRAKVFDIDLQNQLRPYMESMVPLPGIYDPDFIAANQESRANNVIKGTKKEQVDQIVKDIREFKEKNKVDKIVVLWTANTERYSNVIVGLNDTMENLLAAVDRDEAEISPSTLYAIACVLENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVSSNAILYEAGEHPDHVVVIKYVPYVGDSKRAMDEYTSEIFMGGNNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 962 - protein, 510 aa, Ginger
MFVEKFRVESPNVRYGEEEIEAVYHYETTDLVHESRDGAYQWIVRPKRVRYDFKTQTRVPKLGVMLVGWGGNNGSTLTAGVIANREGISWVTKDKVQQADYFGSLTQASTIRVGSYNGEEIYAPFKSLLPMVNPDDIVFGGWDISNMNMADAMGRAKVLDIDLQKQLRPYMESMVPLPGIFEPDFVAANQGARANNVIKGTKSEQVQQIIKDIREFKEQTQVDKVVVLWTANTERYSNVIVGLNDTMENLMASLEKNETEISPSTLYGIACVLENVPYINGSPQNTFVPGLIEMAIQRNSLIGGDDFKSGQTKMKSVLVEFLVGAGIKPTSIVSYNHLGNNDGMNLSAPQTFRSKEISKSNVVDDMVSSNGILYEPGEHPDHVIVIKYVPYVGDSKRAMDEYTSEIFMGGRSTIVLHNTCEDSLLAAPIILDLVLLAELSTRIQLKEEGEGKFHSFHPVSAILSYLTKAPLVPPSTPVVNALAKQRAMLENILRACVGLAPENNMNLEYK

SEQ ID NO: 963 - protein, 510 aa, Taxus
MFIESFRVQSPNVKYTEESIDSVYDYETTELVHENTNGKYEWVVKPKTVKYDFKTDTRVPKLGVMLVGWGGNNGCTLTAGVIANREGISWVTKDKVQQANYFGSLTQASTCRIGSFNGEEIYAPFKSLLPMVDPNDIVFGGWDISNMNLADAMARAKVLEVDLQMQLRPYMQDMVPLPGIFDPDFIAANQGERANNIIKGSKKEQVQQIIQDIREFKAKTKVEKIVVLWTANTERYSDVIVGLNDTKETLFASLEKNESEISPSTLYAIACVQENIPFINGSPQNTFVPGLIDFAIEKNSLIGGDDFKSGQTKMKSVLVDFLVGAGIKPTAIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPLILDLVLLAELSTRIQLKKEGEAKFHSFHPVATILSYLTKAPLVPPGTPIVNALAKQRAMLENIMRACVGLAPENNMILEYK

SEQ ID NO: 964 - protein, 483 aa, Momordica
TTELIHENKNGSYQWTVKPKIVKYEFKTDTRLPKLGVMLVGWGGNNGSTLTGGVIANREGISWATKDKVQPANYFGSLTQASSIRVGSYNGEEIYAPFKSLLPMVNPDDIVFGGWDISDMSLADAMARAKVFDIDLQKQLRPYMESMVPLPGIYDPDFIAANQDSRANNVIKGTKKEQVQKVINDIKEFKEKSKVDKVVVLWTANTERYSNVVVGLNDTMESLLASLDKNEAEISPSTLYAIACVLENVPFINGSPQNTFVPGLIDLAIRRNSLIGGDDFKSGQTKMKSVLVDFLVGAGIKPTSIVSYNHLGNNDGMNLSAPQTFRSKEISKSNVVDDMVSSNGILYEPGEHPDHIVVIKYVPYVGDSKRAMDEYTSEIFMGGKSTIVLHNTCEDSLLAAPIILDLVLLAELSSRIQLKAGGEEKFHSFHPVATILSYLTKAPLVPPGTPVVNALSKQRAMLENILRACVGLAPENNMILEYK

SEQ ID NO: 965 - protein, 510 aa, Podocarpus
MFIESFRVQSPNVKYSEESIESVYDYETTELVHENRNGKYEWVVKPKTVKYEFKTQTRVPKLGVMLVGWGGNNGCTLTAGVIANREGISWVTKEKVQQANYFGSLTQASTCRIGSYNGEEIYAPFKSLLPMVDPNDIVFGGWDISNMNLADAMARAKVLDIDLQKQLRPYMQDMMPLPGIFDPDFIAANQGERANNIIKGSKKEQVHKIIQDIREFKAKTKVDKVVVLWTANTERYSDVIVGLNDTKETFLASLERNESEISPSSLYALACIEENVPFINGSPQNTFVPGLIDLAIEKNSLIGGDDFKSGQTKMKSVLVDFLVGAGIKPTAIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPLILDLVLLAELSTRIQLKKEGEEKFHSFHPVATILSYLTKAPLVPPGTPVVNALAKQRAMLENIMRACVGLAPENNMILEYK

SEQ ID NO: 966 - protein, 510 aa, Curcuma
MFVEKFRVESPNVRYGEEEIESVYYYDTTDLVHESRDGAYQWIVRPKRVRYDFKTQTRVPKLGVMLVGWGGNNGSTLTAGVIANREGISWVTKDKVQQADYFGSLTQASTIRVGSYNGEEIYAPFKSLLPMVNPDDIVFGGWDISNMNMADAMGRAKVLDIDLQKQLKPYMESMVPLPGIFEPDFVAANQGARANNVIKGTKSEQVQQIIKDIREFKEQTKVDKVVVLWTANTQRYSNEIDGLNDTMENLMASLEKNETEISPSTLYGIACVLENVPYINGSPQNTFVPGLIEMAIQRNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGRSTIVLHNTCEDSLLAAPIILDLVLLAELSTRIQLKEEGEGKFHSFHPVSAILSYLTKAPLVPPGTPVVNALAKQRAMLENILRACVGLAPENNMNLEYK

SEQ ID NO: 967 - protein, 510 aa, Sciadopitys
MFIEKFRVQSPNVKYTEESIESVYDYSTTELVHENINGKYEWVVKPKSVKYEFKTDARVPKLGVMLVGWGGNNGSTLTAGVIANREGISWVTKEKVQQANYFGSLTQASTCRIGSYNGEEIYAPFKSLLPMVDPNDIVFGGWDISNLNLADAMARAKVLDIDLQKQLRPYMHDMAPLPGIYDPDFIAANQGERADNIIKGSKKDQVQKIIQDIREFKSKTKVDKVVVLWTANTERYSDVIVGLNDTKQTLLASLERNESEISPSTLYAMACIQENVPFINGSPQNTFVPGLIELAIEKNSLIGGDDFKSGQTKIKSVLVDFLVGAGIKPTAIVSYNHLGNNDGMNLSAPQTFRSKEISKSSVVDDMVSSNAILYGPGEHPDHVIVIKYVPYVGDSKRAMDEYTSEIFMGGKNTIVLHNTCEDSLLAAPLILDLVLLAELSTRIQLKKEGEPKFHSFHPVATILSYLTKAPLVPPGTPVVNALAKQRAMLENILRACVGLSPENNMILEYK

SEQ ID NO: 968 - protein, 510 aa, Cephalotaxus
MFIEKFRVQSPNVKYSEESIESVYDFETTELVHQNTNGKYEWVVKPKSVKYQFKTDTRVPKLGVMLVGWGGNNGSTLTAGVIANREGISWATKDKVQQANYFGSLTQASTCRIGSYNGEEIYAPFKSLLPMVDPNDIVFGGWDISDLNLADAMARAKVLDIDLQKQLRPYMQDMVPLPGIFDPDFIAANQGERANHIIKGSKKEQVQQIVQDITEFKAKTKVDRVVVLWTANTERYSNVMVGLNDTKETLLASLERDELEISPSTLYALACIQENIPFINGSPQNTFVPGLIELAIEKNSLIGGDDFKSGQTKMKSVLVDFLVGAGIKPTAIVSYNHLGNNDGMNLSAPQTFRSKEISKSNVVDDMVSSNAILYGPGEHPDHVIVIKYVPYVGDSKRAMDEYTSEIFMGGKSTIVLHNTCEDSLLAAPLILDLVLLAELSTRIQLKKEDEAKFHSFHPVATILSYLTKAPLVPPGTPVVNALAKQRAMLENIMRACVGLAPENNMILEYK

SEQ ID NO: 969 - protein, 510 aa, Cephalotaxus
MFIESFRVQSPNVKYTEESIESVYDYATTELVHENTNGRYEWVVRPKTVTYDFRTDTRVPKLGVMLVGWGGNNGSTLTAGVIANREGISWVTKDKVQQANYFGSLTQASTCRIGSFNGEEIYAPFKSLLPMVDPNDIVFGGWDISDMNLADAMARAKVLDIDLQKQLRPYMQDMIPLPGIFDPDFIAANQGERANNIVKGSKKEQIEKIIQDIREFKAKTKVEKVVVLWTANTERYSDVIVGLNDTKETLFASVERNESEISPSTLYAIACVQENVPFINGSPQNTFVPGLIDFAIEKNSLIGGDDFKSGQTKMKSVLVDFLVGAGIKPTAIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPLILDLVLLAELSTRIQLRKEGEAKFHSFHPVATILSYLTKAPLVPPGTPVVNALAKQRAMLENIMRACVGLAPENNMILEYK

SEQ ID NO: 970 - protein, 510 aa, Cephalotaxus
MFIESFRVQSPNVKYTEESIESVYDYATTELVHENTNGRYEWVVKPKTVTYDFRTDTRVPKLGVMLVGWGGNNGSTLTAGVIANREGISWVTKDKVQQANYFGSLTQASTCRIGSFNGEEIYAPFKSLLPMVDPNDIVFGGWDISDMNLADAMARAKVLDIDLQKQLRPYMQDMIPLPGIFDPDFIAANQGERANNIVKGSKKEQIEKIIQDIREFKAKTKVEKVVVLWTANTERYSDVIVGLNDTKETLFASVERNESEISPSTLYAIACVQENVPFINGSPQNTFVPGLMDFAIEKNSLIGGDDFKSGQTKMKSVLVDFLVGAGIKPTAIVSYNHLGNNDGMNLSAPQTFRSKEISKSNVVDDMVSSNAILYGPGEHPDHVIVIKYVPYVGDSKRAMDEYTSEIFMGGKSTIVLHNTCEDSLLAAPLILDLVLLAELSTRIQLRKEGEAKFHSFHPVATILSYLTKAPLVPPGTPVVNALAKQRAMLENIMRACVGLAPENNMILEYK

SEQ ID NO: 971 - protein, 510 aa, Distylium
MFIESFRVQSPNVKYTEDSIEAVYDYATTELVHENRNGKYEWVVKPKSVKYEFKTDTRVPKLGVMLVGWGGNNGSTLTAGVIANREGISWVTKEKVQQANYFGSLTQASTCRIGSYNGEEIHAPFKSLLPMVDPNEIVFGGWDINNMNLADAMARAKVLEIDLQKQLRPYMQDMLPLPGIYDPDFIAANQGERANNIIKGSKKEQVDRIIQDIREFKASTKVENIVVLWTANTERYSDVIVGLNDTKENLFASLERNEFEISPSTLYALACVQENIPFINGSPQNTFVPGLIELAIEKNSLIGGDDFKSGQTKMKSVLVDFLVGAGIKPTAIVSYNHLGNNDGMNLSAPQTFRSKEISKSNVVDDMVSSNAILYGPGEHPDHVVVIKYVPYVGDSKRAMDEYTSEIFMGGRNTIVLHNTCEDSLLAAPLILDLVLLAELCSRIQLKREGESKFHSFHPVATILSYLTKAPLVPPGTPVVNALAKQRAMLENILRACVGLAPENNMILEYK

SEQ ID NO: 972 - protein, 510 aa, Sciadopitys
MFIERFRVQSPNVKYGEGSIQSVYDYSTTELVHDNNNGKYEWVVRPKTVKYEFNTDSRVPKLGVMLVGWGGNNGSTLTAGVIANREGISWVTKDKVQQANYFGSLTQASTCRIGSYNGEEIYAPFKSLLPMVDPNDIVFGGWDINNMNLADAMARAKVLDIDLQKQLRPYMQDMAPLPGIFDPDFIAANQGERANNIIKGSKKEQVQQIVRDIREFQAKTKVEKVVVLWTANTERYSDVIVGLNDNKETLLASLERDEPEISPSTLYALACVQENVPFINGSPQNTFVPGLIDLAIEKNSLIGGDDFKSGQTKMKSVLVDFLVGAGIKPTAIVSYNHLGNNDGLNLSAPQTFRSKEISKSNVVDDMVSSNAILFGPGEHPDHVVVIKYVPNVGDSKRAMDEYTSEIFMGGKNTIVLHNTCEDSLLAAPLILDLVLLAELSTRIQLKKEGEAKFHSFHPVATILSYLTKAPLVPPGTPVVNALAKQRAMLENIMRACVGLAPENNMILEYK

SEQ ID NO: 973 - protein, 82 aa, Sequoia
MSSFSTQPVGAMDSVSSVVSMLKGTLERKKLGTNQFNKGIPIDNAFGPYVHDENIYCMNQNHNSFFKFLSLKKGCKQLSLSK

SEQ ID NO: 974 - protein, 510 aa, Maritime pine
MFIQNFRVESPNVKYSEECIDSIYDYQTTELVHENANGKYEWVVKPKTVRYEFKTERRVPKLGVMLVGWGGNNGSTLTAGVIANREGISWVTKEKVQQANYFGSLTQASTCRVGSFNGEEIHAPFKSLLPMVDPNAIVFGGWDINNMNLADAMARAKVLDIDLQKQLRPYMQGMNPLPGIYDPDFIAANQGERANNVIKGSKKEQLQKIIEDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVVNALAKQRAMLENIMRACVGLAPENNMTLEYK

SEQ ID NO: 975 - protein, 512 aa, Zamia
MFIESFRVESPYVKYTEESIESVYNYETTEVVHSRDSRTGKYEWIVKPTTVKYEFHTQTRVPKLGVMLVGWGGNNGSTLTAGVIANREGMSWLTKEGARRANYFGSLTQASTCRVGSFHGEEIYAPFKSLLPLVDPNDIVFGGWDINDMNLADAMARAKVLDIDLQKQLRPYMEGMVPLPGIYDADFIAANQDSRANNIIKGTKKEQVQRIVQDIREFRAKTKVERVVVLWTANTERYSNVLAGLNDTEENLLASLERNEAEISPSTLYALACIQENVPFINGSPQNTFVPGLIDLAISKNSLIGGDDFKSGQTKMKSVLVDFLVGAGIKPTAIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPLILDLVLLAELCTRIKLKKEGEGKFHSFHPVATILSYLTKAPLVPPGTPVVNALAKQRAMLENILRACVGLAPENNMMLEYK

SEQ ID NO: 976 - protein, 510 aa, Pine
MFIQSFRVDSPNVKYSEESIDSIYDYQTTELVHENANGKYEWVVKPKTVRYEFKTERRVPKLGVMLVGWGGNNGSTLTAGVIANREGISWVTKEKVQQANYFGSLTQASTCRIGSFNGEEIHAPFKSLLPMVDPNAIVFGGWDINNMNLADAMARAKVLDIDLQKQLRPYMQGMTPLPGIYDPDFIAANQGERANNVIKGSKKEQLQKIIQDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVVNALAKQRAMLENIMRACVGLAPENNMTLEYK

SEQ ID NO: 977 - protein, 510 aa, Podocarpus
MFIESFRVQSPNVKFTEESIESVYEYSTTELVHENKNGKFEWIVKPKSVIYEFKTDRRVPKLGVMLVGWGGNNGSTLTAGVIANREGISWVTKDSVQQANYFGSLTQASTCRIGSFNGEEIYAPFKSLLPMVDPNEIVFGGWDISDLNLADAMTRAKVLDIDLQKQLRPYMTDMEPLPGIYDPDFIAANQGERANNIIKGSKKEQVHKIIQDIREFKAKTKVERVVVLWTANTERYSEVMVGLNDTKENLLASLERNEAEISPSTLYALACIEENVPFINGSPQNTFVPGLIEMAIEKNSLIGGDDFKSGQTKMKSVLVDFLVGAGIKPTAIVSYNHLGNNDGMNLSAPQTFRSKEISKSNVVDDMVSSNAILYGPGEHPDHVVVIKYVPYVGDSKRAMDEYTSEIFMGGKNTIVLHNTCEDSLLAAPLILDLVLLAELCTRIQLKKEGEAKFHSFHPVATLLSYLTKAPLVPPGTPVVNALAKQRAMLENILRACIGLAPENNMMLEYK

SEQ ID NO: 978 - protein, 491 aa, Flaveria
KFTLCTTTTPLNSFTRRKTVLINGLLSQTVKYEFKTQTRVPKLGVMLVGWGGNNGSTLTAGVIANREGISWATKEKVQQANYFGSLTQASTIRVGSFNGEEIFAPFKSLLPMVNPDDIVFGGWDISSMNLADAMARAKVLDIDLQKQLRPYMESMVPLPGIYDPDFIAANQGERADNVIKGTKNEQIQKIIKDIREFKEANKVDKVVVLWTANTERYSNVMVGLNDTMESLFASLDKNEAEISPSTLYAIACILENVPFINGSPQNTFVPGVIDLAIKRNSLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEDEGKFHSFHPVATILSYLTKAPLVPPGTPVVNALAKQRAMLENILRACVGLAPENNMILEYK

SEQ ID NO: 979 - protein, 510 aa, Cycas
MFVQSFRVESDNVKYSEDSIESVYNYETTELVHENRNGKYEWVVKPRTVKYQFETDRRVPKLGVMLVGWGGNNGSTLTAAVIANREGISWVTKERVQRANYFGSLTQASTCRIGSFNGEEIYAPFKSLLPMVDPNDIVFGGWDINDMNLADAMARAKVLDIDLQKQLRPYMESMVPLPGVYDPDFIAANQGSRANNIIGGTKKEQVQKIVQDIREFKTKTNVEKVVVLWTANTERFSNVVVGLNDTEENLLASVERNESEIAPSTLYALACVQENVPFINGSPQNTFVPGLIDLAVSKNTLIGGDDFKSGQTKIKSVLVDFLVGAGIKPTSIVSYNHLGNNDGMNLSAPQTFRSKEISKSSVVDDMVSSNAILYEPGEHPDHVIVIKYVPYVGDSKRAMDEYTSEIFMGGRNTIVIHNTCEDSLLAAPIILDLVLLAELCTRIKLKKEGEGKFHSFHPVASILSYLTKAPLVPPGTPVVNALAKQRAMLENILRACIGLAPENNMLLEYK

SEQ ID NO: 980 - protein, 510 aa, Pine
MFIQSFRVDSPNVNYSEESIDSIYDYQTTELVHENANGKYEWVVKPKTVRYEFKTERRVPKLGVMLVGWGGNNGSTLTAGVIANREGISWVTKEKVQQANYFGSLTQASTCRIGSFNGEEIHAPFKSLLPMVDPNAIVFGGWDINNMNLADAMARAKVLDIDLQKQLRPYMQGMTPLPGIYDPDFIAANQGERANNVIKGSKKEQLQKIIQDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVVNALAKQRAMLENIMRACVGLAPENNMTLEYK

SEQ ID NO: 981 - protein, 510 aa, Spruce
MFIQSFRVESPNVKYSEESIDSIYDYQTTELVHENVNGKYEWVIKPKSVRYEFKTERRVPKLGVMLVGWGGNNGSTLTAGVIANRLGISWVTKEKIQQANYFGSLTQASTCRIGSFKGEEIHAPFKSLLPMVDPNDIVFGGWDINNMNLADAMARAKVLDIDLQKQLRPYMQGMNPLPGIYDPDFIAANQGERANNVVKGSKKEQVQKIIQDIRDFKSKTKVDKVVVLWTANTERYSDVIVGFNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVVNALAKQRAMLENIMRACVGLAPENNMTLEYK

SEQ ID NO: 982 - protein, 510 aa, Spruce
MFIQSFRVESPNVKYSEESIDSIYDYQTTELVHENVNGKYEWVVKPKAVRYEFKTERRVPKLGVMLVGWGGNNGSTLTAGVIANREGISWVTKEKVQQANYFGSLTQASTCRIGSYKGEEIHAPFKSLLPMVDPNDIVFGGWDINNMNLADAMARAKVLDIDLQKQLRPYMQGMSPLPGIYDPDFIAANQGERANNVLKGSKKEQVQKIIQDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEEKFHSFHPVASILSYLTKAPLVPPGTPVVNALAKQRAMLENIMRACVGLAPENNMTLEYK

SEQ ID NO: 983 - protein, 510 aa, Spruce
MFIQSFRVESPNVKYSEESIDSIYDYQTTELVHENVNGKYEWVVKPKAVRYEFKTERRVPKLGVMLVGWGGNNGSTLTAGVIANREGISWVTKEKVQQANYFGSLTQASTCRIGSYKGEEIHAPFKSLLPMVDPNDIVFGGWDINNMNLADAMARAKVLDIDLQKQLRPYMQGRSPLPGIYDPDFIAANQGERANNVLKGSKKEQVQKIIQDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVVNALAKQRAMLENIMRACVGLAPENNMTLEYK

SEQ ID NO: 984 - protein, 510 aa, Cedrus
MFIQNFRVESPNVKYSEDSIDSIYDYQTTELVHENVNGKYEWVVKPTSVRYEFKTERRVPKLGVMLVGWGGNNGSTLTAGVIANREGISWVTKEKVQQANYFGSLTQASTCRIGSFKGEEIHAPFKSLLPMVDPNDIVFGGWDINNMNLADAMARAKVLDIDLQKQLRPYMQGMAPLPGIYDPDFIAANQGERANNVLKGSKKEQVQKIIQDIRDFKSKTKVDKVVVLWTANTERYSDVIVGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYGPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVLNALAKQRAMLENIMRACVGLAPENNMTLEYK

SEQ ID NO: 985 - protein, 510 aa, Gnetum
MFIENFRVESPNVTYTEESIESVYGYQTTELVHENRNGTYQWIVRPKEVKYEFKTDRQVPKLGVMLVGWGGNNGCTLTAGVIANREGISWVTKDKVQQANYFGSLTQASTCRIGSYNGEEIYAPFKSLLPLVDPNDIVFGGWDISNMNLADAMARAKVLEMDLQKQLRPYMQGMTPLPGIYDPDFIAANQGERANNIVKGSRKEQMLKIIQDIREFKANTKVDKVVVLWTANTERYSNVVVGLNDTKENLLAALDRNELEISPSTIYAIACVLEGVPFINGSPQNTFVPGLIDLAVEKNSLIGGDDFKSGQTKLKSVLVDFLVGAGLKPTSIVSYNHLGNNDGMNLSAPQTFRSKEISKSNVVDDMVSSNAILYEQGEHPDHVVVIKYVPYVGDSKRAMDEYTSEIFMGGKNTLVIHNTCEDSLLAAPLILDLVLLAELCTRIQLKKEGEAKFHSFHPVASLLSYLTKAPLVPPGTPVVNALAKQRAMLENVMRACVGLAPENNMTLEYK

SEQ ID NO: 986 - protein, 510 aa, Abies
MFIQSFRVESPNVKYSEESIESVYDYQTTELVHENVSGKYEWVVKPKSVRYEFKTDRRVPKLGVMLVGWGGNNGSTLTAGVIANREGISWVTKEKVQQANYFGSLTQASTCRIGSFKGEEIHAPFKSLLPLVDPNDIVFGGWDINNMNLADAMARAKVLDIDLQKQLRPYMQCMSPLPGIYDPDFIAANQGERANHVLEGSKKEQVQKIIQDIRDFKSETKVDKVVVLWTANTERYSDVIMGLNDTKETLLASLERNESEISPSTLYGLACVQENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVVVIKYVPYVGDSKRAMDEYTSEIFMGGKNTLVIHNTCEDSLLAAPLILDLVLLAELCTRIQLKKEGEGKFHSFHPVASILSYLTKAPLVPPGTPVLNALAKQRSMLENIMRACVGLAPENNMTLEYK

SEQ ID NO: 987 - protein, 508 aa, Brachypodium
MFVEGFKVESPHVRYGAGEIESEYRYDTTEVAPSPEGTGWVVRPKSVTYNFKTSTAVPKLGVMLVGWGGNNGTTLTAGVIANRLAISWATKEKVQKANYFGSLTQASAIRVGSYNGEEIYAPFKSLVPMVNPNDIVFGGWDISSLNLADAMGRAKVLDIDLQKQLRVYMESMVPLPGIYNPDFIAANQGSRANNVIKGTKKEQVEQIIKDIREFKEKNKVDKVVVLWTANTERYSDVVVGLNDTMDNLLASLDKNMAEISPSSMYAIACVTEGIPFINGSPQNTFVPGLIELAIKKNSLIGGDDFKSGQTKMKSVLVDFLVGAGIKPTSIASYNHLGNNDGMNLSAPQVFRSKEISKSGVVDDMVASNGILYNPGEHPDHVIVIKYVPYVGDSKRAMDEYTSEIFMGGRNTIVLHNTCEDSLLAAPIILDLVLLAELSTRIQLKAQGQEKFHSFHPVATILSYLSKAPLVPPGTPVVNALAKQRAMLENILRACVGLAPENNMMLEHK

SEQ ID NO: 988 - protein, 510 aa, Taxus
MFVERFRVQSPNVKYNEESIESVYDYETTELVHQNTNGKYEWVVIPKSVRYHFNTHTRVPKLGVMLVGWGGNNGSTLTAGVIANREGISWVTKEKVQQANYFGSLTQASTCRIGSYNGEEIHAPFKSLLPMVDPNDIVFGGWDISNLNLADAMARAKVLDIDLQKQLRPYMQDMVPLPGIFDPDFIAANQGERANNIIKGSKKEQVQQIVQDITEFKVKTKVDRVVVLWTANTERYSNVMVGLNDTKETLLASLERDESEISPSTLYALACIQENIPFINGSPQNTFVPGLIEFAIEKNSLIGGDDFKSGQTKMKSVLVDFLVGAGIKPTAIVSYNHLGNNDGMNLSAPQTFRSKEISKSNVVDDMVSSNAILYGPGEHPDHVIVIKYVPYVGDSKRAMDEYTSEIFMGGKSTIVLHNTCEDSLLAAPLILDLVLLAELSTRIQLKKEGEAKFHSFHPVATILSYLTKAPLVPPGTPVVNALAKQRAMLENIMRACIGLSPDNNMILEYK

SEQ ID NO: 989 - protein, 220 aa, Pine
MFIQNFRVESPNVKYSEECIDSIYDYQTTELVHENANGKYEWVVKPKTVRYEFKTERRVPKLGVMLVGWGGNNGSTLTAGVIANREGISWVTKEKVQQANYFGSLTQASTCRVGSFNGEEIHAPFKSLLPMVDPNAIVFGGWDINNMNLADAMARAKVLDIDLQKQLRPYMQGMNPLPGIYDPDFIAANQGERANNVRKSSCKRLSKISEILNRKQRWTR

SEQ ID NO: 990 - protein, 472 aa, Canola
TYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAITKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPPGTPVVNALSKQRAMLENILRACVGLAPENNMILEYK

SEQ ID NO: 991 - protein, 265 aa, Gnetum
MFIENFRVESPNVTYTEESIESVYGYQTTELVHENRNGMYQWIVRPKEVKYEFKTDRKVPKLGVMLVGWGGNNGSTLTAGVIANREGISWVTKDKVQPANYFGSLTQASTCRIGSYNGEEIYAPFKSLLPLVDPNDIVFGGWDISNMNLADAMARAKVLEMDLQKQLRPYMQGITPLPGIYDPDFIAANQGERANNIVKGSRKEQMLKIIQDIREFKANTKVDKVVVLWTANTERYSNVVVGLNDTKENLLAETNWKFLRPQSTP

SEQ ID NO: 992 - protein, 510 aa, Pseudotsuga
MFIQSFRVESPNVKYSEESIDSTYDYQTTELVHENANGKYEWVIKPKSVRYEFKTERRVPKLGVMLVGWGGNNGSTLTAGVIANREGISWVTKEKVQQANYFGSLTQASTCRIGSYKGEEIHAPFKSLLPLAEPNDIVFGGWDINNMNLADAMARAKVLDIDLQKQLRPYMQGMFPLPGIYDPDFIAANQGERANNVLKGSKKEQLEKIVQDIRDFKSKTKVDKVVVLWTANTERYSDVIVGLNDTKETLLASLERNESEISPSTLYGLACVLENVPFINGSPQNTFVPGLIDLAITKNSIIAGDDFKSGQTKMKSVLVDFLVGAGLKPTSIVSYNHLGNNDGMNLSAPQTFRSKEISKSNVVDDMVASNAILYEPGEHPDHVIVIKYVPYVGDSKRAMDEYTSEIFMGGKNTLVIHNTCEDSLLAAPLILDLVLLAELCTRIQLKKEGEAKFHSFHPVASILSYLTKAPLVPPGTPVLNALAKQRAMLENIMRACVGLAPENNMTLEYK

SEQ ID NO: 993 - protein, 509 aa, Rice
MFVEGFRVESPRVRYGDGEIESEYRYDTTEVVAPPSPEKGWVVRPKSVTYHFKTTTTVPKLGVMLVGWGGNNGTTLTAGVIANREGISWATKEKVHKANYFGSLTQSSTIRVGSYNGEEIYAPFKSLVPMVNPNDIVFGGWDISSMNLADAMTRARVLDIDLQKQLRHHMESMVPLPGVYNPDFIAANQGSRANNVIKGTKKEQVEQVKKDIREFKEKSKVDKVVVLWTANTERYSNVVAGMNDTMDNLLASLDKDEPEMSPSTLYAIACVMEGVPFINGSPQNTFVPGLIELAIKKNSVIGGDDFKSGQTKMKSVLVDFLVGAGIKPTSIASYNHLGNNDGMNLSAPQTFRSKEISKSGVVDDMVSSNAILYEPGEHPDHVIVIKYIPYVGDSKRAMDEYTSEIFMGGKNTIVLHNTCEDSLLAAPIILDLVLLAELSTRIQLKAEDQDKYHSFHPVATILSYLSKAPLVPPGTPVVNALAKQRAMLENILRACVGLAPENNMMLEYK

SEQ ID NO: 994 - protein, 509 aa, Foxtail_millet
MFVEGFRVESPRVRYGAGEIESEYRYDTTEVVPPGDGGAGWVVRPKSVTYNFKTSTSVPKLGVMLVGWGGNNGTTLTAGVIANREGISWETKEKVHKANYFGSLTQASTIRVGSHNGEEVYAPFKSLVPMVDPNSIVFGGWDISNLSMADAMARAKVLDINLQKQLRPYMQSMVPLPGIFNPDFVAANQGARANNLIQGTKKEQVEQIKKDIREFKEKNKVDKVVVLWTANTERYSNVVTGLNDTMDNLMASLEKNEAEISPSTLYAIACVSEGVPFVNGSPQNTFVPGLIELAIKKNSLIGGDDFKSGQTKMKSVLVDFLVGAGIKPTSIASYNHLGNNDGMNLSAPQVFRSKEISKSSVVDDMVASNPILYSPGEHPDHVIVIKYIPYVGDSKRAMDEYTSEIFMGGKNTIVLHNTCEDSLLAAPIILDLVLLAELSTRIQLKAEGQDKFHSFHPVATILSYLSKAPLVPPGTPVVNALAKQRAMLENILRACVGLAPENNMILEHK

SEQ ID NO: 995 - protein, 509 aa, Maize
MFAESFRVESPRVRYGDGEIQSEYRYDTTEVVPPGNSGAGWVVRPKSVTYNFKTSTNVPKLGVMLVGWGGNNGTTLTAGVIANREGISWETKEKVHKANYFGSLTQASTIRVGSHNGEEIYAPFKSLVPMVNPNTIVFGGWDISNLNMADAMARAQVLDIHLQKQLRPYMESMQPLAGIFNPDFVAANQGARANNIIKGTKKEQVEQIRKDIREFKEKTKVDKVVVLWTANTERYSNVVAGLNDTMDNLLASLDKNEAEISPSTLYAIACVFEGVPFVNGSPQNTFVPGLMELAIKKNSVIGGDDFKSGQTKMKSVLVDFLVGAGIKPTSIASYNHLGNNDGMNLSAPQVFRSKEISKSSVVDDMVASNPILYKPDEHPDHVIVIKYIPYVGDSKRAMDEYTSEIFMGGKNTIVLHNTCEDSLLASPIILDLVLLAELSTRIQLKAEGQDKFHSFHPVATILSYLSKAPLVPPGTPVVNALAKQRAMLENILRACIGLAPENNMMLEHK

SEQ ID NO: 996 - protein, 510 aa, Zamia
  misc_feature (214)..(214): Xaa can be any naturally occurring amino acid
  misc_feature (260)..(260): Xaa can be any naturally occurring amino acid
MFVESFRVESPNVKYSEESIESVYNYETTEVVHQCKNGKYEWIVKPTTVKYQFNTDRRVPTLGVMLVGWGGNNGTTLTAGVIANREGISWLTKEGVQQANYFGSLTQASTCRIGSFNGEEIYAPFRSLLPMVDPNDIVFGGWDINDMNLADAMARAKVLDVDLQKQLRPYMEGMVPLPGIYDPDFIAANQDSRANNIIGGTKKEQVQKIVQDIXEFKAKTKVEKVVVLWTANTERYSNVSVGLNDTEENLLASLERNESXISPSTLYALACVQENVPFINGSPQNTFVPGLIDLAISKNSLIAGDDFKSGQTKMKSVLVDFLVGAGIKPTAIASYNHLGNNDGLNLSAPQTFRSKEISKTNVVDDMVSSNGILYGPGEHPDHVIVIKYIPYVGDSKRAMDEYTSEIFMGGRSTIVLHNTCEDSLLAAPIILDLILLAELCSRIKLKKEGEGKFHSFHPVASILSYLTKAPLVPPGTPVINALAKQRAMLENILRACIGLAPENNMLLEYK

SEQ ID NO: 997 - protein, 446 aa, Potato
MLVGWGGNNGSALTGGVIANREGISWATKDKVQQANYFGSLTQASTIRVGSFNGEEIYAPFKSILPMVNPDDVVFGGWDISNMNLADAMARAKVFDIDLQKQLRPYMESMVPLPGIYDPDFIAANQGSRANNVIKGTKKEQIDQIIKDIREFKENNKVDKVVVLWTANTERYSSVAVGLNDTMENLFASVDRNEAEISPSTLYAIACILENVPFINGSPQNTFVPGLIDLAIKRNTLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGRNTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 998 - protein, 509 aa, Millet
MFVEGFRVDSPRVRYGAGEIESEYRYDTTEVVPPADGGAGWVVRPMSVTYNFKTSTTVPKLGVMLVGWGGNNGTTLTAGVIANREGISWETKEKVHKANYFGSLTQASTIRVGSHNGEEVYAPFKSLVPMVDPNSIVFGGWDISNLSMADAMARAKVLDINLQKQLKPYMQSMVPLPGVFNPDFVAANQGARANNLIQGTKKEQVEQIKKDIREFKEKNKVDKVVVLWTANTERYSNVVAGLNDTMDNLMASLEKNEAEISPSTLYAIACVSEGVPFVNGSPQNTFVPGLIELAIKKNSLIGGDDFKSGQTKMKSVLVDFLVGAGIKPTSIASYNHLGNNDGMNLSAPQVFRSKEISKSSVVDDMVASNPILYSPGEHPDHVIVIKYIPYVGDSKRAMDEYTSEIFMGGKNTIVLHNTCEDSLLAAPIILDLVLLAELSTRIQLKAEGQDKFHSFHPVATILSYLSKAPLVPPGTPVVNALAKQRAMLENILRACVGLAPENNMILEHK

SEQ ID NO: 999 - protein, 212 aa, Cleome gynandra
MFIESFKVESPNVKYTENEIHSVYNYETTEVVHENINGVYQWIVKPKTVKYEFKTDVHVPKLGVMLVGWGGNNGSTLTAGVIANKEGISWATKDKVQQANYFGSLTQASSIRVGSFNGEEIYAPFKSLLPMVNPDDVVFGGWDINDMNLADAMEGPRFLTLICRSNSDLTWRTWSHSQGSTILISSQRIKIHVPITSSKAPRRNKLIRSLKT

SEQ ID NO: 1000 - protein, 449 aa, Clover
LGVMLVGWGGNNGSTLTGGVIANREGISWATKDNIQQANYFGSLTQASAIRVGSFQGEEIHAPFKSLLPMVNPDDIVFGGWDISNMNLADAMARARVFDIDLQKQLRPYMESMVPLPGIYDPDFIAANQGERANNVIKGTKREQINQIIKDIREFKEANKVDRVVVLWTANTERYSNLVVGLNDTTENLFAAVDRNESEISPSTLFGIACVLENVPFINGSPQNTFVPGLIDLAIKNNSLIGGDDFKSGQTKMKSVLVDFLVGAGIKPTSIVSYNHLGNNDGMNLSAPQTFRSKEISKSNVVDDMVNSNAILYAPGEHPDHVVVIKYVPYVGDSKRAMDEYTSEIFMGGKNTIVLHNTCEDSLLAAPIILDLVLLAELSTRIQFKSEAENKFHTFHPVATILSYLTKAPLVPPGTPVVNALSKQRAMLENIMRACVGLAPENNMILEYK

SEQ ID NO: 1001 - protein, 510 aa, Pteridium
MFIESFRIESPNVEYTEDYIQSSYEYSTTELLHEKRGGQYQWVVKPTSVHYQFKTSRRVPKLGVMLVGWGGNNGATLTAGVIANREGISWVTKEGVQQANYFGSLTQASTCRVGSFNGEEIYAPFKSLLPMVDPNDIVFGGWDINGANLADAMSRAKVLDMDLQKQLRPYMEEIVPLPGIYDPDFIASNQGARANNLIKGTKKQQMEQIVSDIREFKAKSMVDKVVVLWTANTERYSDVIVGLNDTKENLFKSLERGEPEISPSTLYALACIQEKVPFINGSPQNTFVPGVIEYAVSQNSLIGGDDFKTGQTKIKSVLVDFLVGAGIKPTSIVSYNHLGNNDGMNLSAPQTFRSKEISKSNVVDDMVGSNAILYKPGEHPDHVVVIKYVPYVGDSKRAMDEYTSEIFMGGRNTIVLHNTCEDSLLAAPLILDLVLLAELLTRIELKKEGEDKFHSLHPVAALLSYLTKAPLVPPGTPVINALAKQRAMLENIFRACIGLAPENNMLMEYK

SEQ ID NO: 1002 - protein, 461 aa, Oil palm
NTLQDRHPYPQARCNACGDGVGTMDPPSPLVLLPTEKGSPGATKDKVQRANYFGSLTQASTIRVGSFNGEEIYAPFKSLLPMVNPDDIVFGGWDISNMNLADAMARAKVLDIDLQKQLRPYMESMVPLAGIYDPDFIAANQGSRANNVIKGTKKEQVQQIIKDIREFKEKMKVDKVVVLWTANTERYSNVLVGVNDTMDNLLASLEKNQAEISPSTLYAIACVLENVPFINGSPQNTFVPSLIDLAIQKNSLIGGDDFKSGQTKMKSVLVDFLVGAGIKPTSIVSYNHLGNNDGMNLSAPQTFRSKEISKSSVVDDMVSSNGILYEPGEHPDHVIVIKYVPYVGDSKRAMDEYTSEIFMGGRSTIVLHNTCEDSLLAAPIILDLVLLAELSTRIQLKAEEEGKFHSFHPVATILSYLTKAPLVPPGTPVVNALSKQRAMLENILRACIGLAPENNMMLEHK

SEQ ID NO: 1003 - protein, 586 aa, Zostera
MAMEMVATSAVSLRAHRSNSFLSNDIKTTRGLFPPSNLTRRRLVMTLDVKQGDNMVELKSNQSGTQIPIDQKAPTFVENFRVDSPDVKYGENEIETEYKYDTTELVYENRNGSNSKQWYVKPKSVVYNFKTSTRVPKLGVMLVGWGGNNGSTLTAGVIANRESMSWPTKEKMLHANYFGSLTQASTVRVGSYNGEEIYAPFKSLLPMVDPNDVVFGGWDINGMNLADAMDRAKVLDYELQRQLKPIMESMVPLPGIYDPDFIAANQGSRADNVIKGTKKEQLRQIINDIRDFKDKTKVDKVVVLWTGNTERYSKIVDGLNDTSDNLLAALDRNESEISPSTIYAMACILEKIPFINGSPQNTFVPGLIELAIKNNTMIGGDDFKSGQTKMKSVLVDFLVGAGIKPTSIVSYNHLGNNDGMNLSAPQTFRSKEISKSNVVDDMVASNPILYEPGEHPDHVVVIKYVPYVGDSKRAMDEYSSELFMGGKSTIILHNTCEDSLLAAPIILDLVLLAEMSTRIQLKAEGEENFHSFHPIATILSYLSKAPLVPPGTPVVNALSKQRAMLENIMRACIGLAPENNMLLEHK

SEQ ID NO: 1004 - protein, 476 aa, Rye
MFIESFRVESPNVRYGAGEIESEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDIVFGGWDISSMNLADAMTRAKVLDIDLQKQLRPYMESITPLPGIYDPDFIAANQGSRANNVLKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKAPCRLARV

SEQ ID NO: 1005 - protein, 469 aa, Rye
MFIESFRVESPNVRYGAGEIESEYRYDTTELVHESHDGASKWVVRPKSVNYHFKTNTNVPKLGVMLVGWGGNNGSTLMAGVIANREGISWATKDKVQQANYFGSLTQASTIRVGSYNGEEIYAPFKSLLPMVNPDDIVFGGWDISSMNLADAMTRAKVLDIDLQKQLRPYMESITPLPGIYDPDFIAANQGSRANNVLKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFHSFHPVATILSYLTKA

SEQ ID NO: 1006 - protein, 461 aa, Canola
KYEFKTDTHVPKLGVMLVGWGGNNGSTLTAGVIANREGISWATKEKVQQANYFGSLTQASSIRVGSFNGEEIYAPFKSLLPMVNPEEIVFGGWDISDMNLADAMGRAKVLDIDLQKQLRPFMEHMVPLPGIYDPDFIAANQGSRANHLIKGTKKEQLEQVIKDIRDFKEKNKVDKVVVLWTANTERYSNVVAGLNDTTENLMSSLDKNEAEISPSTLYAIACVLENVPFINGSPQNTFVPGLIELAIKRNSLIGGDDFKSGQTKMKSVLVDFLVGAGIKPTSIVSYNHLGNNDGMNLSAPQTFRSKEISKSNVVDDMVASNGILFDSGEHPDHVVVIKYVPYVGDSKRAMDEYTSEIFMGGKNTIVMHNTCEDSLLAAPIILDLVLLAELTTRIELKADNEGKFHSFHPVATLLSYLSKAPLGPTWHASCERLSKQRAMLENILRACVGLAPENNMILEYK

SEQ ID NO: 1007 - protein, 479 aa, Distylium
MFIESFRVQSPNVKYTEETIESVYDYATTELVHENRNGKYEWVVKPKCVKYEFKTARRVPKLGVMLVGWGGNNGSTLTAGVIANREGISWVTKDKIQQANYFGSLTQASTCRVGSYNGEEIHAPFKSLLPMVEPNDVVFGGWDISNLNLADAMARAKVLDIDLQKQLRPYMQDMMPLPGIFDPDFIAANQGERANHIIKGSKKEQVDKIIQDIREFQANTKVEKVVVLWTANTERYSDVIVGLNDTKENLLASLNKNKSEISPSTLYAIACIQENVPFINGSPQNTFVPGLIELAIEKNSLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGQNTIVMHNTCEDSLLAAPLILDLVLLAELSTRIQLKKEGEAKFHSFHPVATILSYLTKDPSWWPPRHTS

SEQ ID NO: 1008 - protein, 452 aa, Utricularia
LPKFGVLLVGWGGNNGSTLTAGVIANREGISWATKDKIQPANYFGSLTQASTIRVGSFNGEEIYAPFKSLVPMVNPDEIVFGGWDISNMNLADSMARAKVLDIDLQKQLRPYMEQMVPLPGIYDPDFIAANQESRANNVIGGTKKEQVDRIIKDIREFKEKNQLDKVVVLWTANTERYSSIVAGLNDTMENLLASVEKNEAEISPSTLYAIACVLENVPFINGSPQNTFVPGLIELAIKRNSLIGGDDFKSGQTKMKSVLVDFLVGAGIKPTSIVSYNHLGNNDGMNLSAPQTFRSKEISKSNVVDDMVASNAILYEPGEHPDHVVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 1009 - protein, 136 aa, Rye
MFIESFRVESPNVRYGGGGDRVGVPLRHHGAGAREPRRRIQVGRPPQVRQLPLQDQHQRPQARGDARGVGRQQWLHTHGWGHRQRGEGISVGDQGQGAASQLLWVPHPGLHHQGRELQRRGDLCALQEPPAHGEPR

SEQ ID NO: 1010 - protein, 511 aa, Spikemoss
MFIESFRVESPNVKYSEEHISSVYDYNTTDLVHEKNREGKYEWVVKPSTVTYEFQTQRKVPKLGIMLVGWGGNNGSTLTAGIIANREGISWVTKDGVQRPNYFGSVTQASTCRIGSFRGEEIYAPFKSLLPMVNPDDVVLGGWDINNMNLADAMERAKVLDMDLQKQLRPYMDKMVPLPGVYDPDFIAANQGSRANNIFKGSKKEKMDKIIEDIRHFKSQTKVDKVVVLWTANTERYSDVIVGLNDTKENLFASLERDEPEISPSTIYALACIQEGVPFINGSPQNTFVPGVIDFAVEKGTLIGGDDFKSGQTKMKSVLVDFLVGAGIKPTSIVSYNHLGNNDGMNLSAPQTFRSKEISKSNVVDDMVSSNAILFKPGEHPDHVIVIKYVPYVGDSKRAMDEYTSEIFMGGRSTIAMHNTCEDSLLAAPLILDLVLLAELCSRIQLKREGEEKFHSFHPVAALLSYMTKAPLVPPGTPVINALSKQRACLENVLRACIGLAPENNMLLEYK

SEQ ID NO: 1011 - protein, 415 aa, Momordica
MMLVGWGGNNGSTLTGGIIANREEISWATKDKVQQANYFGSLTQASSIRVGSTDGEEIYAPFKSLLPMVNPDDVVFGGWDISDMNLADAMARAKVLDIDLQKQLRPYMESMVPLPGIFDPDFVAANQGSRANNVIKGTKKEQLQQIIKDIREFKEKSKVDKIVVLWTANTERYSNVIVGLNDTMENLLASVDKNESEISPSTLYAIACVLENVPFINGSPQNTFVPGLIDLAIHRNSLIGGDDFKSGQTKMKSVLVDFLVGAGIKPTSIVSYNHLGNNDGMNLSAPQTFRSKEISKSNVVDDMVSSNGILFEPGEHPDHVVVIKYVPYVADSKRAMDEYTSEIFMGGKSTIVMHNTCEDSLLAAPIILDLVLLAELSTRIQFKAEGRESFTLSILWLPSSVTLQRLLLYRQAHQW

SEQ ID NO: 1012 - protein, 519 aa, Sorghum
MFVESFRVDSPLVQYGDGEIQSEYRYDTTEVVPPGNGGGAGWMVRPKSVTYNFKTSTNVPKLGCIVSNDGCRVMLVGWGGNNGTTLTAGVIANREGISWETKEKVHKANYFGSLTQASTIRVGSHNGEEVYAPFKSLVPMVDPNSIVFGGWDISNLNMADAMARAKVLDIHLQKQLRPYMESMLPLAGIFNPDFVAANQGARANNIIKGTKKEQVEQIKKDIREFKEKTKVDKIVVLWTANTERYSNVVSGLNDTMDNLLASLEKNEAEISPSTLYAIACVFEGVPFVNGSPQNTFVPGLMELAIKKNSVIGGDDFKSGQTKMKSVLVDFLVGAGIKPTSIASYNHLGNNDGMNLSAPQVFRSKEISKSSVVDDMVASNPILYKLNEHPDHVIVIKYIPYVGDSKRAMDEYTSEIFMGGKNTIVLHNTCEDSLLAAPIILDLVLLAELSTRIQLKAEGQDKFHSFHPVATILSYLSKAPLVPPGTPVVNALAKQRAMLENILRACIGLAPENNMMLEHK

SEQ ID NO: 1013 - protein, 451 aa, Amaranthus
PKLGVMLVGWGGNNGSTLTGGVIANREGISWATKDKVQQANYFGSLTQASSIRVGSFNGEEIYAPFKSLLPMVNPDDIVFGGWDISDLNLADAMTRAKVLDIDLQKQLRPYMEHMIPLPGIYDPDFIAANQDSRANNIIKGTKKEQIEQVIKDMREFKEKNKVDKVVVLWTANTERYSDVVVGLNDTMENLMAAVERNESEISPSTLYAIACALENVPFINGSPQNTFVPGLIELAIKHNSLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGKSTIVLHNTCEDSLLAAPIILDLVLLAELSSRIQLKAETEDKFHSFHPVATILSYLTKAPLVPPGTPVVNALSKQRAMLENIMRACVGLAPENNMILEYK

SEQ ID NO: 1014 - protein, 511 aa, Spikemoss
MFIESFRVESPNVKYSEEHISSVYDYNTTDLVHEKNREGKYEWVVKPSTVTYEIQTQRKVPKLGIMLVGWGGNNGSTLTAGIIANREGISWVTKDGVQRPNYFGSVTQASTCRIGSFRGEEIYAPFKSLLPMVNPDDVVLGGWDINNMNLADAMERAKVLDMDLQKQLRPYMDKMVPLPGVYDPDFIAANQGSRANNIFKGSKKEKMDKIIEDIRHFKSQTKVDKVVVLWTANTERYSDVIVGLNDTKENLFASLERDEPEISPSTIYALACIQEGVPFINGSPQNTFVPGVIDFAVEKGTLIGGDDFKSGQTKMKSVLVDFLVGAGIKPTSIVSYNHLGNNDGMNLSAPQTFRSKEISKSNVVDDMVSSNAILFKPGEHPDHVIVIKYVPYVGDSKRAMDEYTSEIFMGGRSTIAMHNTCEDSLLAAPLILDLVLLAELCSRIQLKREGEEKFHSFHPVAALLSYMTKAPLVPPGTPVINALSKQRACLENVLRACIGLAPENNMLLEYK

SEQ ID NO: 1015 - protein, 478 aa, Watermelon
MFIDSFKVESPNVTYSDHEIHSIYNYDTTELLHENRNGTYQWIVKPKSVQYQFKTDIRVPKLGMMLVGWGGNNGSTLTGGIIANREGISWATKDKVQQANYFGSLTQASSIRVGSIDGEEIYAPFKSLLPMVNPDDIVFGGWDISDMNLADAMARAKVLDIDLQKQLRPYMESMVPLPGIFDPDFVAANQGSRANNVIQGTKKEQLQQIIKDIREFKEKSKVDKIVVLWTANTERYSNVIVGLNDTMENLLASVDKNESEISPSTLYAIACVLENVPFINGSPQNTFVPGLIDLAIHRNSLIGGDDFKSGQTKMKSVLVDFLVGAGIKPTSIVSYNHLGNNDGMNLSAPQTFRSKEISKSNVVDDMVSSNGILYEPGEHPDHVVVIKYVPYVGDSKRAMDEYTSEIFMGGKSTIVLHNTCEDSLLAAPIILDLVLLAELSTRIQFKAEGEVSFTLSTLWPPSSVTLQRLLLYRQARLW

SEQ ID NO: 1016 - protein, 535 aa, Soybean
MALHYPFPTYFILLLVTITRLIYTVGKTEQWKAPILTELDINNISHKLHDDPEIIQMASRDYGHIVHEFPLAVFRPSSIDDIATLIKSSYNSFAPFGIAARGQGHSTHGQAMARDGVVVDMANLRKQRNGVAISVSKDPLMGHYADVGGEQLWIDVLHTTLKHGLAPVSWTDYLYLTVGGTLSNAGISGQSFRYGPQISNVHEMDVITGKGEFVTCSSQKNLELFHAVLGGLGQFGVIARARIALEPAPKRVKWVRLLYSDFFAFTKDQERLISINGRKQKNALDFLEGMLLMNQGPINNWRSSFFPLSDHPRISSLITEHSILYCLEVAKYYDEQTEINVDKEIQVLLQGLAYIPGFYYEKNVSYVEFLNRVRSGELKLQSQGLWDVPHPWLNLFIPKSQILDFNSRVFKDIVLKRNISSGPVLVYPTNRNKWDDRMSASIPDEEVFYTVGFLHSSGFDTWKAYDAQNSEILEFCRDAGIKVKQYLPNHSTQEDWTNHFGAKWIKFLERKHQFDPRMILSPGQKIFHKQLQPAF

SEQ ID NO: 1017 - protein, 535 aa, Bean
MALNYPSSTYFILLVVTITRLIYTEGKTEQWKGLILPDLDFENIFHKLHDDPETIQMASSDYGHIVHELPAAVFHPSSIEDIATLIKSSYNSLAPFHIAARGQGHSHHGQAMARDGVVVDMATLRKQRNGVSISVSKDPLIGHYADVGGEQLWIDVLHASLEHGLAPVSWTDYLYLTVGGTLSNAGISGQSFRYGPQISNVHEMDVITGKGEFVTCSTQKNLELFNAVLGGFGQFGVIARARIALETAPKRVKWVRLLYSDFSAFTKDQERLISINGRKQKNALDFLEGMLLMNQGPINNWRSSFFPLSDHPRIASLITEHGILYCLEVAKYYDDQTEKNVDKEIHVLLQGLAYIPGFYYEKNVSYVEFLNRVRSGELKLQSQGLWEVPHPWLNLFLPKSQILDFNSGVFMDIILKRNISSGPVLVYPMNRNKWDDRMSASIPDEDVFYTVGFLHSSGFDSWKAHDAQNREILEFCRDAGIKVKQYLPNHSTQEDWTNHFGTKWLKFLERKHQFDPRMILSPGQKIFHKQLQPAF

SEQ ID NO: 1018 - protein, 536 aa, Pigeonpea
MALNHPLSTYFILLLITITRLISIVGKTEQWKKAPILQELDIDNISLKFHDDPETIQIASRDYGNIVHEFPRSVFRPSSIDDIVTLIKSSYNSPSPFHIAARGQGHSTNGQAMAREGVVVDMATLRKQRNGVAINVSKDPLIGHYADVGGEQLWIDVLHSTLEHGLAPVSWTDYLYLTVGGTLSNAGISGQSFRYGPQISNVHEMDVITGKGEFVTCSWQKNLELFHAVLGGLGQFGVIARARIALEPAPKRVKWVRLLYSDFSAFTKDQERLISINGRKQKTALDFLEGILLMNQGPINNWRSSFFPISDHPRIASLITQHSIIYCLEVAKYYDDQTEKNVDKEIKVLLQGLVYIPGFYYEKNVSYVEFLNRVRSGELKLQSQGLWDVPHPWLNFFIPKSQILDFDSGVFRDIVLKRNISSGPVLVYPMNRNKWDDRMSASIPEEDVFYTVGFLHSSGFDNWKEYDAQNREILEFCSDAGIEVKQYLPNHTTQEDWSNHFGAKWVTFLERKRQFDPRMILSPGQKIFDKQLQQAF

SEQ ID NO: 1019 - protein, 419 aa, Cowpea
MGIPWDDVVVIQQGKDLNEPCIVTVNCPDKAGLGCDLCRIILEFGLRITRADISTDGRWCYIVFWVLPNPASIKVDWESLKTRLLSVCPSCLFSYHFNQLSTSPSPPLIYLLKVWCVDQKGLLHDINEILCNLELIIQRVKAMPTPDGRVLDMFFITDGMELLHTKKRQDYVCESLKDALGERCISSELQLAGPEYGHLQGFSSLPPAFAEELFSSELLDKVSLHPLSQDMKTLKTPTVTVDNSLSPVHTLLQIQCVDQKGLCYDIMRISKDSDIKVAFGRFSSSVEGFRNIDLFVQQNDGKKIIDPDSQKTLCSCLKEEMLHPLRVIIASRGPDTELLVANPVELSGKGRPRVFYDVTLALKALGVCIFSAEVVRHSTQERQWEVYRFLLEENRNFPLTRSQTRSQIVDKVRRTLMGW

SEQ ID NO: 1020 - protein, 419 aa, Bean
MGIPWDDGVVIQQGKDANEPCIVTVNCPDKAGLGCDLCRIILEFGLRITRADISTDGRWCYIVYWVLPHPASVKVDWESLKTRLLSACPSCLFSYCFNQLSTSPSPPPIYLLKVWCVDKKGLLHDINEILCNLELIIQRVKAMPTPDGRVLEMLFITDGMELLHTKKRQDHVSEFLMDALGERCISSELQLAGPEYGHLQGFSSLPPAFAEELFSSELLDKVSLHPLSQDMKTLKTPTVTVDNSLSPVHTLLQIQCVDQKGLCYDIMRISKDSDIKVAFGRFSSSVEGFRNIDLFVQQNDGKKIIDLDSQKTLCSCLKEEMLHPLRVIIVSRGPDTELLVANPVELSGKGRPRVFYDVTLALKALGICIFSAEVVRHSTQERQWEVYRFLLEENRNFPLTRSQTRSQIVDKVRRTLMGW

SEQ ID NO: 1021 - protein, 418 aa, Pigeonpea
MGIPWDDVVVIQQGKDPGDPCIVTVNCPDKAGLGCDLCQIILEFGLRITRADISTDGRWCYIVYWVVPHPASLKVDWESLKIRLLSACPSCLFSYYFKNSTCPSPPPVYLLKVWCVDQKGLLHDINEILCNLQLIIQRVKAMPTPDGRVLDMFFITDGMELLHTKKRQDYVCEYLKEALGERCISSELQLAGPEYGHLQGFSSLPPAFAEELFSSELLDKVSLHPLSQDMRTLKTPTVIVDNSLSQAHTLLQIQCVDQKGLCYDIMRISKDSDIKVAFGRFSSSVKGFRNIDLFVQQKDGKKIIDPESQKTLCSSLKEEMLHPLRVIIVNRGPDTELLVANPVELSGKGRPRVFYDVTSALKALGVFIFSAEVVRHSTQERQWEVYRFLLEESREFPLTRSQARSQIVDKVRRTLMGW

SEQ ID NO: 1022 - protein, 419 aa, Lotus
MGIPFEDLVVIREGKNLDEPSVVTVNCPDKAGLGCDLCRIILEFGLRVTRADVSTDGRWCYIVYWVVPHPASLKVDWESLKTRLLSACPSCLFSYYFNQQSTTPSPPPIYVLKVWCVDQKGLLHDINEILCNLQLIIQRVKAMPTPDGRVLDLFFITDGMELLHTKKRQDYVCEYLMDALGERCISSELQLAGPEYGQIQGFSSLPPAFSEELFGSELLDKVYMHPLSKDMTTLKKPTVMVDNSLSPVHTLLQIQCVDQKGLCYDIMRISKDSDIKVAYARFSSSVKGFQNIDLFVQQNDGKKIIDPELQKTLCSCLKEEMLHPLRVIIVNRGPDTELLVANPVELSGKGRPRVFYDVTLALKALGVFVFSAEVVRHSTQERQWEVYRFLLDESHGFPLTSSKARSQIVDKVRRTLMGW

SEQ ID NO: 1023 - protein, 420 aa, Peanut
MGIPWDDVVVIQHGKDKNDPTVVTVNCPDKAGLGCDLCRITLEFGLRIKKADISTDGRWCYIVFWVVPNPSSLTVDWGSLKTRLLSACPSCLLTYHLNQQLTTSPSPPPIYLLKVWLIDQKGLLHDINEILCNLELLIQRVKVMPTPDGRALDMFFINDGMELLHTKKRQDYVCEFLKDALGDRCISTELQLAGPEYGQLQGISSLPPAFAEELFSSELLDKGSLHPLSQDMAPLKKPTVMVDNSLSPAHTLLQIECVDQKGLCYDIMRISKDSDIKVAHGRFSSSAKGFRSIDLLVQQKDGKKIIDPESQKTLCSCLKEEMLHPLRVIIVNRGPDTELLVANPVELSGKGRPRVFYDVTLTLKALGVMIFSAEIVRHSTQERQWEVYRFLLDESRDFPLTSSKARSQIVDKVRRTLMGW

SEQ ID NO: 1024 - protein, 418 aa, Medicago
MGIPSDDLVVIQHAKNANEPTIVTVNCPDKAGLGCDLCRIILEFGLRITRADISTDGRWCFIVFWVIPHPASLKIDWENLKTRLLSPCPSCLFSYNFNQRNPSPPPIYLLKVWIIDQKGLLHDINEILCNLQLTIQRVKVMPTPDGRALDLFFITDEMELFHTKERRDDVCQYLSEALGERCISSELQLAGPEYGHLQGFSSLPPAYSEELFGPELVDKVSLHPLSQDMTTLKTPTVTVDNSLSSVHTLLQIQCVDQKSLCYDLMRISKDSDIKVAYGRFNSSAKGFQNIDLFVQQKEDGQKIIDPERLKTLCTCLKEEMLHPLRVIIVNRGPDIELLVANPVELSGKGRPRVFYDVTLALKALGVFIFSAEVVRHSTQERQWEVYRFLLDESRDFPLNSSKARSQIVDKVRRTLMGW

SEQ ID NO: 1025 - protein, 559 aa, Soybean
MDSWVRMLFLIACIVPALVECKVRHYKFNVVLKNTTRLCSSKPIVTVNGKFPGPTLYAREDDTVLVKVNNLVNHNVTIHWHGVRQLRTGWADGPAYITQCPILSGQSYLYNFTLTGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHPFTVVEVDASYVKPFKTDTLSIAPGQTTNALLTADQNSGKYTIVASTFMDSPVVAVDNLTATATLHYTGTLATTPTLLTTPPPRNATQVANNFTNSLKSLNSKKYPAKVPQKVDHSLLLTVGLGINPCPSCTAGNGSRVVAAVNNVTFVMPTTALLQAHYFNIKGVFTTDFPGNPSHVYNYTATPPAAAWQTTNGTKAYRLAFNSTVQVVLQDTGVIAPESHPVHLHGFNFFVVGSGVGNYDPKTDQNNFNLADPVERNTIGVPTGGWVAFRFRADNPVWFLHCHFEVHTTWGLKMAFLVDNGKGPNESLLPPPKDLPKC

SEQ ID NO: 1026 - protein, 560 aa, Bean
MDSWVRVLLFIACIVPALVECKVRHYKFNVVLKNTTRLCSSKPIVTVNGKFPGPTLYAREDDTVLVKVRNLVNHNVTIHWHGVRQIRTGWADGPAYITQCPILPGQSYLYNFTLTGQRGTLLWHAHVNWLRSTLHGAIVILPKHGVPYPFPKPVKELVVILGEWWKSDTEDVINEALKSGLAPNVSDAHTINGLPGIVFVANCSTQDVYKLPVESGKTYLLRIINAALNEETFFKIAGHLFTVVEVDASYVKPFKTDTLLIAPGQTTNALLTTDQNSGKYTIVASTFMDSPVVAVDNLTATATLHYTGTLATTPTVLITPPPRNATQVANNFTKSLKSLNSKKYPANVPLTVDHSLLFTVGLGINPCPSCTAGNGSRVVAAVNNVTFVMPTTALLQAHYFNTQGVFTTDFPGNPPQVYNYTATPRAASSQTTNGTKVYRLAFNSTVQVVLQDTGVIALESHPIHLHGFNFFVVGSGVGNYDPKTDGSNFNLVDPVERNTIGVPTGGWIALRFRADNPGVWFLHCHFEVHTTWGLKMAFLVDNGKGPNESLIAPPNDLPKC

SEQ ID NO: 1027 - protein, 560 aa, Pigeonpea
MDSWVRMLFLIAFIVPALVECKVRHYKFHVVLKNTTRLCSSKAIVTVNGKFPGPTLYAREDDTVLVKVRNLVNHNVTIHWHGIRQLRTGWADGPAYITQCPILPGQSYLYNFTITGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHSLTVIEVDASYVKPFKTDTLLIAPGQTTNALLTADQNSGKYIIVASTFMDASVVAIDNLTATATLHYTGTLASTPTILTTPPPRNATQVATNFTKSLKSLNSKKYPANVPLTVDHSLLFTVGLGINPCPSCTAGNGSRAVAAVNNVTFVMPTTALLQAHYFNIKGVFTTDFPGNPAHVYNYTATPATASSQTKNGTKVYRLKFNSTVQVVLQDTGVIAPESHPVHLHGFNFFAVGSGVGNYDPKTGPNNFNLVDPVERNTIGVPTGGWVAIRFRADNPGVWFLHCHFEVHTTWGLKMAFLVDNGEGPNESLIPPPKDLPKC

SEQ ID NO: 1028 - protein, 557 aa, Pigeonpea
MDSHWVRIILLIACILPALVECRVRHYKFHVVAKKTTRLCSSKSIVTINGKFPGPTLYAREDDTVLVKVINQVNHNVTIHWHGVRQLRTGWADGPAYVTQCPIQPGQTYVYNFTLTGQRGTLLWHAHVNWLRSTLHGALVILPKRGVPYPFPKPDDELVVVLGEWWKSDTEAVINEALKSGLAPNVSDAHTINGLPGTVTNCSTQDVYNLPVESGKTYLVRIINAALNEELFFKIAGHKLTVVEVDATYVKPFKIETIVIAPGQTTNVLLTADQKSGKYLVAASPFMDAPVAVDNLTATATLHYTGTLATTPTILTTPPQKNATQVANNFINSLKGLNSKKYPVNVPLTVDHSLFFTVGLGINPCPSCKAGNGSRVVAAVNNVTFVMPTIALLQAHYFNIGGVFTTDFPAKPPHVFNYSGTGPANLNTTSGTKLYRLPFNATVQVVLQDTGIIAPENHPVHLHGFNFFIVGRGVGNYNPNTDPKNFNLADPVERNTVGVPAGGWTAIRFRADNPGVWFMHCHLEVHTTWGLKMAFLVDNGKGPKQSVIPPPNDLPKC

SEQ ID NO: 1029 - protein, 557 aa, Soybean
MDSHWVRMVLLIACILPALVECRVRHYKFHVVSKQTNRLCSSKSIVTINGKFPGPTLYAREDDTVLVKVINQVNHNVTIHWHGVRQLRTGWADGPAYVTQCPIQPGQTYLYNFTLTGQRGTLLYHAHVNWLRSTLHGALVILPKRGVPYPFPKPDDELVVVLGEWWKSDTEAIINEALKSGLAPNVSDAHTINGLPGAVTNCSTQDVYNLPVESGKTYLLRIINAALNEELFFKIAGHKLTVVEVDATYVKPFKIETILIAPGQTTNVLLNADQKFGKYLVAASPFMDAPIAVDNLTATATLHYTGTLAATPTILTTPPPKNSTQIANNFISSLRGLNSKKYPVNVPLTVDHSLFFTVGLGISPCPSCKAANGSRVVAAINNVTFIMPTIALLQAHYFNIKGVFTTDFPANPPHLFNYSGPGPANLNTETGTKVYRVPFNATVQVVLQDTGIIAPENHPVHLHGFNFFVVGRGVGNFNPKIDPKNFNLVDPVERNTIGVPAGGWTAFRFRADNPGVWFMHCHLEVHTTWGLKMAFLVDNGKGPKQSVIPPPKDLPKC

SEQ ID NO: 1030 - protein, 557 aa, Soybean
MYSHWVRLMLLIACILPALVECRERHYKFHVVSKQTNRLCSSKSIVTINGKFPGPTLYAREDDTVLVKVINQVNHNVTIHWHGVRQLRTGWADGPAYVTQCPIQPGQTYVYNFTLTGQRGTLLYHAHVNWLRSTLYGALVILPKRGVPYPFPKPDDELVVVLGEWWKSDTEAVINEALKSGLAPNVSDAHTINGLPGTVTNCSTQDVYNLPVESGKTYLLRIVNAALNEELFFKIAGHKLTVVEVDATYVKPFKIETIVIAPGQTTNVLLNANQKSGKYLVAASPFMDAPVAVDNLTATATLHYTGTLAATPTILTTPPPKNATQIANNFISSLRGLNSKKYPVNVPLTVDHSLIFTVGLGINPCPSCKAANGSRVVAAINNVTFIMPTIALLQAHYFNIKGVFTTDFPANPPHVFNYSGPGPANLNTETGTKVYRLPFNATVQVVLQDTGIIAPENHPVHLHGFNFFVVGRGVGNFNPKIDPKNFNLVDPVERNTIGVPAGGWTAFRFRADNPGVWFMHCHLEVHTTWGLKMAFLVDNGKGPKQSVIPPPKDLPKC

SEQ ID NO: 1031 - protein, 557 aa, Medicago
MVSWIRVLLLICCIFPALVECKVRHYKFHVVAKNTSRLCSSKAIVTVNGKFPGPTLYAREDDTVIVKVRNQVNNNITIHWHGIRQLRTGWADGPAYITQCPIQPGHSYTYNFTITGQRGTLLWHAHVNWLRSTVHGAIVILPKKGVPYPFPKPDDELVLVLGEWWKSDTEAVINEALKSGLAPNVSDAHTINGLPGTVANCSTQDVYKLPVESGKTYLLRIINAALNEELFFKIAGHKLTVVEVDATYTKPFQIETIVIAPGQTTNVLLKANQKSGKYLVAASPFMDAPVAVDNLTATATLHYSGTTLTNTPTFLTTPPPTNATQIANNFLNSLKGLNSKKYPVNVPLKIDHSLFFTVGLGVNPCPSCKAGNGSRVVAAINNVTFVMPTTALLQAHYFNIKNVFTADFPPNPPHIYNFTGAGPKNLNTTSGTKLYKLSFNDTVQLVMQDTGIIAPESHPVHLHGFNFFVVGRGVGNYDSKNDSKKFNLVDPVERNTVGVPAGGWVAIRFRADNPGVWFMHCHLEVHTTWGLKMAFLVDNGKGPKQSVIAPPKDLPKC

SEQ ID NO: 1032 - protein, 274 aa, Cowpea
MDSALRTVGVKYECLLFDMDDTLYPLSIGLNLFCRKNIQEYMLEHLHIEEDEVPKMCLDLYREYGTTMAGLKVLGYEFDNDEFHAYVHGRLPYEKLKPDPVLRNLLLSMPQRKIIFTNADHAHAVKVLNRMGLEDCFEGIICFETLNPHKQINCMDLPNDDNVLTDLTENGCFNSQTHILCKPSVEAFEAAIRIANVDPKKTIFFDDSVRNVASAKVAGLHTVILGHSDLVPGADHALNSIHNIKEALPEIWEIEEGNQQQKIQPPAVETMVLA

SEQ ID NO: 1033 - protein, 271 aa, Pigeonpea
MDTDHRAGGVKYECLLFDMDDTLYPLSLGLNLFCRQNIQEYMLEHLHIEESEVPKMCLDLYREYGTTMAGLKLLGYEFDNDEFHAYVHGRLPYEKLKPDPVLRNLLLSMPQRKIIFTNADHAHAVQVLNRLGLEDCFEGIICFETLNPLKQINVPDNDHVPTDSTDSGSFNSHSQILCKPSVEAFEAAIRIANVDPNKTIFFDDSVRNVESAKLAGLHTVLVGHSDLVPGADHALNSIHNIKEALPEIWEIEEANQQQKMQPPAVETMVQA

SEQ ID NO: 1034 - protein, 272 aa, Bean
MDTALRNAGVKYECLLFDMDDTLYPLSIGLNLFCRKNIQEYMLEHLHIEENEVPKMCLDLYREYGTTMAGLKVLGYEFDNDEFHAYVHGRLPYEKLKPDPVLRNLLISMPQRKIIFTNADHAHAVKVLNRMGLEDCFEGIICFETLNPHKQYMDLPNDNHVLTDIAESGCFNSHTRILCKPSVEAFEAAIRTSNVDPKKTIFFDDSVRNVASAKVAGLHTVILGHSDLVPGADHALNSIHNIKEALPEIWEIEESNQQQKIQPPAVETMVLA

SEQ ID NO: 1035 - protein, 265 aa, Lotus
MDAHRIDGVKYECLLFDIDDTLYPLSLGLNLACRKNIQEYMLEHLHIEESEVPKMCLDLYIEHGTTMAGLKALGYEFDNDEFHAYVHGRLPYEKLKPDSVLRNLLLSMPQRKIIFTNSDHKHAVEVLNRLGLEDCFEGIICFETLNPPNIDVSDDNHVTESGRFNSHTQILCKPSVEAFEAAIRIANVDPKKTIFFDDSTRNIASAKVAGLHTVMVGRSDLVPGANHALNSIHNIREALPEIWEVEEDSQQQMIQSLAVEAIVLA

SEQ ID NO: 1036 - protein, 529 aa, Soybean
MEASPSTLDWRGRPSNPAKHGGMIPAAFVLGLQAFEIMAIAAVGNNLITYVANDMHFPLSKAANLVTNFVGTIFLLSLLGGYLSDSYLGSFWTMLLFGFVELSGFILLSVQAHVPQLKPPPCNVNDGEQCVEAKGMKAMIFFVALYLVALGSGCVKPNMLAYGGDQFEQNDPKQLKKLSTYFNAAYFAFSVGQLVSLTILVWVQTHSGMDVGFGVSAAVMAMGLISLICGTLYYRNKPPQGSILTPVAQVLVAAFSKRNLPSSPSSMIRVEQVEQVKILLSVIPIFSCTIVFNTILAQLQTFSVQQGRAMDTHLTKSFNIPPASLQSIPYILLIFLVPLYDTFFVPFARKFTGHESGISPLRRIGFGLFLATFSMVAAALLEKKRRDAAVNHHKVLSIFWITPQYLIFGLSEMFTAIGLLEFFYKQSLKGMQAFFTAITYCSYSFGFYLSTLLVSLVNKITSTSSSSAAGWLHNNDLNQDRLDLFYWLLAVLSFLNFLNYLFCYCKELYRSKCRIDRVASIYNILQLQA

SEQ ID NO: 1037 - protein, 567 aa, Soybean
METDKGEAQAQDWRGRPSNPAKHGGMIPAAFVLGLQAFEIMAIAAVGNNLITYVTSEMHFPLSKAANLVTNFVGTIFLLALLGGYLSDSYLGSFWTMLIFGFVELSGFILLSVQAHVPQLKPPPCNINDLGEQCSEAKGMKAMIFFVALYLVALGSGCVKPNMVAYGGDQFDQDNPKQLKKLSTYFNAAYFAFSLGELVSLTILVWVQTHSGMDVGFGVSAAVMAMGLISLICGTLYYRNKPPQGSILTPIAQVLVAAIFKRNLLLPSNPQMLHGTQNNLIHTDKFRFLDKACIRVEQEGNQESAWRLCSVAQVEQVKILLSVIPIFSCTIVFNTILAQLQTFSVQQGRAMDTHLTKSFNIPPASLQSIPYILLIVLVPLYDTFFVPFARKFTGHESGIPPLRRIGFGLFLATFSMVAAALLEKKRRDEAVNHDKVLSIFWITPQYLIFGLSEMFTAIGLLEFFYKQSLKGMQAFLTAITYCSYSFGFYLSTLLVSLVNKITSTSSSAAGWLHNNNLNQDRLDLFYWLLAVLSFLNFLNYLFWSRRYSHAPSALPPPNTKEHHHNIP

SEQ ID NO: 1038 - protein, 584 aa, Bean
METTKVSENEDELHHSQPQSSTLDWRGRPSDPAKHGGVLPAAFILGLQAFEIMAIAAVGNNLITYVTNDMHFSLSKAANVVTNFVGTIFLLALLGGYLSDSYLGSFWTMLIFGFLELSGFILLSVQAHVPQLKPAPCNVLTDGEHCAEAKGFKAVIFFVALYLVALGSGCVKPNMLAYGGDQFEQDNPKQSKKLSTYFNAAYFAFSVGELVSLTILVWVQTHSGMDVGFGVSAAVMAMGLISLICGTLYYRNKPPQGSILTPIAQVLVAAISKRNLVLPSNPQMLHGSQNNTGLLLSDKLGFLDKACIRVQEGENRKESAWRLCSVEQVEQVKILLSVIPIFSCTIVFNTILAQLQTFSVQQGRAMDSHLTKSFNIPPASLQSIPYILLIVLVPLYDTFFVPFARKITGHESGISPLRRIGFGLFLATFSMVAAAVMEKKRRDAAVNLNQTLSIFWITPQFLIFGLSEMFTAIGLLEFFYKQSLKGMQAFLTAITYCSYSFGFYFSTVLVSLVNKITSTSSTGGWLHYNNLNQDRLDLFYWLLAVLSFLNFLNYLFWSKRYHAPSPYQPNAKEINPYVGDDNIP

SEQ ID NO: 1039 - protein, 579 aa, Pigeonpea
MEIDKGDHQDQEESSSLTLDWRGRPSNPAKHGGMVPAAFVLGLQAFEIMAIAAVGNNLITYVTNHMHFPLSKAANVVTNFVGTIFLLALLGGYLSDSFLGSFWTMLIFAFVELSGFILLSVQAHVPQLKPPPCNDGEHCVEAKGFKAMIFFVALYLVALGSGCVKPNMVAYGGDQFDQDNPKQLKKLSTYFNAAYFAFSLGELISLTILVWVQTHSGMDVGFGVSAAVMAMGLISLICGTLYYRNKPPQGSILTPIAQVLVAAISKRKLVCPSNPQMLYGSQNNAALPHTDKLRFLDKACIRVQEGTNTKESPWRLCSVTQVEKVKILVSVIPIFSCTIVFNTILAQLQTFSVQQGRAMDTRLTKSFSIPPASLQSIPYILLIFLVPLYDTFFVPFARKITGHESGISPLRRIGFGLFLATFSMVAAAIMEKKRRDAAVNHNETLSIFWITPQFLIFGLSEMFTAIGLLEFFYKQSLKGMQAFFTAITYCSYSFGFYLSTVLVSLVNKITSTSSSGGWLHYNNLNQDRLDLFYWMLAVLSFFNFLSYVFCSTRYSHAPSSLPQPNSKEINPYSGDDNIP

SEQ ID NO: 1040 - protein, 334 aa, Soybean
MRGSCCCWNRRTEQRFRLLAISTVKSLKIKLLLFCCVAFTLLAFSTSASSFVLWINNQTPPPPPPRFPDSGKGYSIVMNTWKRYDLLKQSIKHYSSCPRLESVHIVWSEPDPPSDILLKFLHHVVKSKSKDGRYVKLRFDINKEDSLNNRFKEIKDLETDAVFSIDDDVIFPCSTVEFAFDVWQSAPDTMVGFVPRVHWVDSLEGNDSKFIYGGWWSVWWTGTYSMVLSKAAFFHKKYFNIYTNEMPSSIREYVTKNRNCEDIAMSFLVANATGAPPIWVKGKILEIGSTGISSLGGHSERRTECVNRFVAAYGRMPLVSTSVKAVDSRNIWFW

SEQ ID NO: 1041 - protein, 329 aa, Pigeonpea
MRGSCWNRRTEQRFRHLAISTVKSVKIKILLCCCVAFTLLAFSTSASSFILWNNQTPPPPRFLDSRKGYSIVMNTWKRYDLLKQSIKHYSSCPRLESVHIVWSEPDPPSDVLLKYLHHVVKSKSKDGRLVKLKFDINKEDSLNNRFKEIKDLETDAVFSIDDDVIFPCSSVEFAFDVWQSAPDTMVGFVPRVHWMDSLEGNSNKFIYGGWWSVWWTGTYSMVLSKAAFFHKKYFNIYTKEMPSSIREYVTKNRNCEDIAMSFLVANATGAPPIWVKGKIFEIGSTGISSLGGHSERRTECVNKFAAVYGGMPLVSTSVKAVDSRNIWFW

SEQ ID NO: 1042 - protein, 331 aa, Bean
MRGSCCGWNRRTEQRFRLLAISTVKSVKIKLLLCCCVALTLLAFSTSASSFVLWNNQTPLPPLLSDSRRGYSIVMNTWKRYDLLKQSIKHYSSCPRLESVHIVWSEPNPPSDILLKFLHHVVKSKPKDGRQVKLRFDINKEDSLNNRFKEIKDLETDAVFSIDDDVIFPCSSVEFAFDVWQSAPDTMVGFVPRVHWLDSLKDNDDKFSYGGWWSVWWTGTYSMVLSKAAFFHKKYFNIYTNEMPSSIREYITKNRNCEDIAMSFLVANATGAPPIWVKGKIFEIGSTGISSLGGHSERRTECVNRFAAVYGRMPLVSTSVKAVDSRNIWFW

SEQ ID NO: 1043 - protein, 330 aa, Chickpea
MRGSCWLNRRIEQRFRLLAISTVKSVKIKLLLCCCVALTLLAFSTSGSTFLLWNNQTSSLRRFPDSRKGYSIVMNTWKRYDLLKQSIKHYSSCPRLESVHIVWSEPNPPSESLLKFLHQAVKSKARDGQYVKLRFDINKEDSLNNRFKEIDDLETDAVFSIDDDVIFPCSSVEFAFDVWQSAPDAMVGFVPRVHWVDSLNGNDNVFKYGGWWSVWWTGTYSMVLSKAAFFHKKYFILYTNEMPSSIREYVTKNRNCEDIAMSFLVANATGAPPLWVKGKIFEIGSTGISSLGGHSERRSECVNIFTAVYGRMPLVYTSVKAVDSRNTWFW

SEQ ID NO: 1044 - protein, 332 aa, Medicago
MRGSCWLNRRIEQRFRLLAISTVKSAKIKLLLFCCVALTLLAFSSTGSSFLLWNNTNQTPQIPSFTDSRKGYSIVMNTWKRYDLLKQSIKHYSSCPRLESVHIVWSEPNPPSESLLKYLHHVVKSKSRDGRYVKLRFDINTEDSLNNRFKEIKDLETDAVFSIDDDVIFPCSSVEFAFDVWQSAPDAMVGFVPRVHWVDSLNGDSNKFRYGGWWSVWWTGTYSMVLSKAAFFHKKYFSLYTNEMPSSIREFVTKNRNCEDIAMSFLVANATGAPPLWVKGKIYEIGSTGISSLGGHSERRSDCVNIFTSVYGRMPLVYTSVKAVDSRNVWFW

SEQ ID NO: 1045 - protein, 257 aa, Peanut
MNTWKRYDLLKQSIKHYSSCPRLDSVHIVWSEPDPPSDSLLKYLYHVVKSVPKDGHQVKLKFDINKEDSLNNRFKEIKDLESDAVFSIDDDVIFPCSSVEFAFDVWQSAPDTMVGFVPRVHWVDYSKGGGSKFKYGGWWSVWWTGTYSMVLSKAAFFHKKYFILYTNQMPTSLKEYITKNRNCEDIAMSFLVANATGAPPIWVKGKIFEIGSTGISSLGGHSEKRSECVNRFASVFGRMPLVSTSVKAVDSRNIWFW

SEQ ID NO: 1046 - protein, 330 aa, Peanut
MRGSWFLKRRPEQRFRLLAASAVKSARINLLLCCCIALVLIVLATTISTFVVFSDFPPSLPRSHASGKGYSIVMNTWKRYDLLKQSIAHYSSCPRLESVHIVWSEPDPPSDDLLKFLLHAIQSKSIDRRQVKLKIDINKEDSLNNRFKVIKDLETDAVFSIDDDVIFPCSSVEFAFDVWQSAPDTMVGFVPRAHWLDSSESGGIKFRYAGWWSVWWTGTYSMVLSKAAFFHKKYFSVYTNEMPASIREYVTHNRNCEDIAMSFLVANATDAPPIWVQGKIFEIGSTGISSLGGHSVRRTECVNRFTAVYGRMPLVSTSVKAVDSRNIWFW

SEQ ID NO: 1047 - DNA, 2562 bp, Glycine max
atgtttcctttcgggcaaaagggtcaaaagataaaggggactatggtggttatgcagaagaatgtgttggatatcaacagcatcaccagtgttggagggatcgttgaccaaggcttaggcttcataggcagtgcagtcgatgcacttacttttgcagccaccaaaatctccatccagttgattagtgctaccaaggctgatggtgggaaaggaaaaattggaaagagtacaaatttaagaggaaagataacattaccaaccttgggagctggcgaacaagcatacgatgttaattttgaatgggacagtgacttcggaattcccggtgcattttatattaagaacttcatgcaaaatgagttctacctcaagtctctaattctcgaagacattccaaaccacggaaccattcacttcgtatgcaactcctgggtttacaattcaaaaaactacaagactgatcgcattttctttgccaacaatacatatcttccaagcgagacaccagctccacttttgaagtacagagaagaagaattgaagaatgtaagaggggatggaactggagagcgcaaggaatgggataggatctatgattatgatgtctacaatgacttgggcaacccggatagcggtgataaatatgcacgccccgttcttggtggttcagccttaccttaccctcgcagaggaagaaccggaagaggaaaaactagaaaagatcccaacagtgagaagccgagcgattttgtttaccttccaagagatgaagcatttggtcacttgaagtcatcagattttctcgcttatggaatcaaatctgtatcccaagatgtcttgcctgtcttgactgatgcattcgatggaaatattttgagccttgagtttgataattttgctgaagtgcacaaactctatgaaggtggagttacactacctacaaactttcttagcaagatcgcccctataccagtgatcaaggaaatttttcgaactgatggcgaacagttcctcaagtatccaccacctaaagtgatgcaggtggataagtctgcatggatgactgatgaagaatttgcaagagaaacgattgctggtttaaatccaaatgtcattaagattatagaggagttcccactaagtagcaagctagatactcaagcctatggtgatcatacctgtataatagcaaaagaacatttggagcctaacttaggtgggctcactgttgagcaggctatccaaaacaagaagttgttcatcttagatcaccatgactatctcattccttatttgaggaaaataaatgcaaataccacaaagacttatgctacaagaaccatatttttcttgaaagatgatggaactttgacaccattggccattgagttaagtaagccacatcctcagggtgaagaatatggtcctgttagcgaagtctacgtgcctgccagcgaaggagtggaagcttatatttggttactggcaaaggcttatgttgttgtgaatgatgcatgctaccatcaaatcattagccattggctaagcactcatgcaattgttgagccatttgtcatagcaacaaacaggcaactgagtgtggttcaccctatttacaaacttctgtttcctcactaccgtgacaccatgaatattaattcacttgcccggaaagccctggtcaatgcagatggtattatagagaaaacattcttgtggggtaggtactctatggaaatgtccgctgtcatttacaaggactgggttttcactgatcaagcattacctaatgatcttgtaaagagaggagttgctgttaaggacccatctgctccccatggagttcgtcttttgattgaggactatccttatgcttctgatgggctagagatatgggatgccatcaagtcctgggtgcaagaatatgtctcattctactacaagtcagatgaggaactccaaaaagaccctgaactccaagcttggtggaaagaacttgtagaggtgggtcatggtgatttgaaagataagccatggtggcaaaagatgcaaactcgtgaagagttggttgaagcttccgctatcctcatatggattgcttcagcccttcatgctgctgttaactttggacagtatccatatggaggtttaatcctaaacaggccaactattagcaggagattcatgcctgaaaaggggtctcctgaatatgatgcgttggctaagaaccctgagaaggagtttttgaagactattactggcaagaaggagaccctcattgaccttacagttatagaaatcttgtcaaggcacgcatctgatgagttctaccttgggcagagagatggtggtgactactggacttctgatgccggtccattagaggcatttaagaggtttggaaagaagcttgaagagattgaaaagaagcttatagagaagaacaaagatgagacattgagaaaccgctatgggccagctaaaatgccttacactctgctctatccttctagtgaggagggattgactttcagaggaattcccaacagtatctctatctaa

SEQ ID NO: 1048 - DNA, 894 bp, Glycine max
atggtttcttctaattgctactatcttgcattggtatgctgctgtgttctgctgctgctgaaccccaccgtgggggagcaggacgagcagaacttggtgctccagtaccacaaaggcgcgctcctcaaggggaggatcaccgttaacctgttatggtacggcagcttcaccccaatccaacgctccacaatcgttgacttcataaagtcgttaagctcctccccgggggccccacttccctcggtggcatggtggtggaagacgacggagaagtacaatgggggatccactacgctggtcgtagggaagcaaatcctgcaacaaacttattccctcggaaagtacctcaacggaacacagctactctatctctcctcacgcttcaacgacctcaacgccatcaacgtcgttctcacatcaaacgacgtcggcgtcgacggcttctgcaggagccgctgtgggacccacggatccattaacgggaaggcccgtataccgtacatgtgggttgggaactccgaggcccagtgccctgggcaatgcgcgtggcccttccaccagcccgcttacggcccacagacgccgccgttagttgctcctaacgccgacgttggggttgacgggatggttataaacatagccacgcttttggcgggaaccgtgacgaacccgttcaacgaggggttctatcagggtcctcccacggcgccgttggaggccgtttcggcctgcacggggattttcgggagcggggcgtatccgggttatccgggtcgggttctgctggacaagacgacgggggccagctacaatgcgtacggcggcaacgggaggaagtacctcttgccggccatgtgggacccgcagacctccgcatgcaagacgcaggtgtaa

SEQ ID NO: 1049 - DNA, 411 bp, Glycine max
atgaatcagaacccgcaatcgagtgaaggaaggaacgatgacgattctgccctttctgatttcctcgcttccttaatggattatactcccactatacctgatgaattggtggagcattacttggccaagagcggtttccaatgtcccgatgttcgattgactagattggtagctgttgccactcagaagtttgttgctgaagttgcaggagatgcacttcagcactgcaaagcaagacaagcaacaattccaaaagacaaaagggacaagcagcagaaggataagcgcctagttttgacaatggaagacctttcaaaggcattgcgtgagtatggcgtgaatttaaagcatcaagaatattttgctgatagcccttctaccggaatggatcctgctacccgagaagaatga

SEQ ID NO: 1050 - DNA, 1233 bp, Glycine max
atgttcaatatgagatttgtatctcaagattgggtggtttcatgtgcactaatacttctggtgtcatgcacaacatactcatcagcttctttggggaaacctgagaacaacataaaaacatctgtttttaaatcacccaagattgagctaggtccagggttagtttcaaacaaattttattttgatgttgactttccaagaggccatattgcactcaagagtttcaatgctgaattggttgatgagtcagagaaatcagtgcctctccaagaaacctatctccatcactgggttataataaaataccaccagccaaaaaatgtgacacacaataaccaaacagataatattgtttttgtgagaaacagtggcttttgccaggatggtactcttatccagtattatggtcttggatcagaaacaagaggaaccgccactgatattccagacccttttggaatagaagttggaaacccttcagaaattccctatggatatgatgagaaatggttgatcaacgtgcatgccattgacacaaggggtgtggaagataggttggggtgcattgagtgtaggtgtgacctttataatatcacaaaggatgcagatggtaaccctctgagtccagattataagggaggtttggattgttgccctgataatacctcgtgcaggctaaacaaaggcttcaagggtccaaagagaaccttataccttaaatacacagtgaagtggttcagttgggacaactacgtggtgccccttaagatttatatacttgatgtgactgatgttttgaacgtgtccaaaggagtgactccaaagcataattgcgaggttgagtatcaggttgaaccttgcagcaaaggctacaatagtagtgcttgcattgatgtcagaaaaacaagcttcccaatgcaaacgggtggatatgtaatctatggtgttggtcatcagcatgcaggtgcaattgcatcaacactatacggacaggatgggggagttatttgttcttcaataccaaaatatggaactggaagtgaagcaggaaatgagaaagggtatgttgtaggaatgtccacatgttaccctcgaccaggtactatcaaaataaaagatggtgaaaccctaactctagagattatctacagcaacagcgaaatgcacagtggagtaatgggacttttctacatcttggtggcagaacaactgccacaccaacacctcctttga

SEQ ID NO: 1051 - DNA, 2097 bp, Glycine max
atggcattagtgtcttcactttctcctgcgaccccttcttcggttcaaaccaacactttgaacccattgggttggactgatgatcagatcctggagaaggtttacattacccacgtccacaccgctgaaaggtacgatgtggaatcgcttttcaacgttactgcaaacatcatcaagcgttctactgcacttgctgacagtgttgctgttaagactggcacacccgttggtcttattgaagacaaggttcctttgtccactttcgacccaccgttcctaaaacttaagcatattgcttctcagatgatgaacacaccgcacggtgagcatcatgcacacagcacagcaatgtcgatccttgaccagctgagaacgtacacatgggatggaaaagcgatattggttctggcggctttggctttggagtatggaaacttctggcacctcgtccagactccgagtggagaccatctgggaagatcactggcacagatgagccgagttcacatcgtggagaggaacaggcaagccgtggctgactacaacagcttggtcaagaacttgctcatcgcggttgagtgcatcaccgagttggagaggctttccaccaaaggttatgacttgaaggacgtcccagccttggcagaagccatgcaagagatccctgttgctgtctactgggctatcgtcaccactgttgtctgtgctaatcactttgatttcctccttggtgaatcggactctagatacgaaatagccaattttgacgacaagcttgcagctgttatcagcaaattaaaggcgaatctcaccaggagcagaaagaaaataggtgacctagaagactactggaggcgtaagaagttgcttcaaacccccacagaaattgtagaggttctcaaggttctgatctaccacaacgaagttcacgacccccatgtctacgatggactcaccagacaaatggttagcatcgaagtgttcaggaagaaacacgtgttactgttcatttcggggcttgacagcatcagagatgaggttcggcttctgcaatcaatctatgagggattacaggaagatccaagggaagtgaaaggatacaggaaagaggatttcaggattctgtgggtccctgtcgtggatgagtggaatcttctgcacagggcagagtatgataacctgaagcttgaaatgccgtggtatgtgacggaatacttctaccccttggcgggaatcaggctcataagggaggacttgaactacaagaataaacccatcatccctgtgctcaaccctcaaggccgggtcgtcaactacaatgcaatgcacatgattttcgtctggggcatcgatgccttccctttcagaccctctgatgatgatgtcctcacccagaaatggaattggttctgggccgaaatgaagaaagtcaatcccaagctgcaagaccttataaaagcggacagtttcatcttcatatatggaggcagtgacaagaagtggctgcaagatttcgctcaggcagtggaaagaatcaaaaggcatgagatcatcaagagggcagacgcggtgatagagcactatccattcggaagggaagatcacaggatcgttcctcgcttctggattggcatagagagcctgttcgcgaacatgattcagaagacacacaaggaccctaccattgaggagattaagagcttgctctgtctgaaacagcaacaacccgggtgggttcttctcagcaaagggtcgaacgtgaagttgttggggagtggggacccaatgctggcaactgcagctgatttcgagatatggaaggaaaaggtgctggagaaagcagggtttgacgtggctttcaaggaatactatgagcagaagcgtcgcaactaccctcaggaatgctcgaacatgcagttggctaactaccctgctgatattcttcaccccattaattgccctgatgctgcttgtggcagatccatggagattgcttctgtaagttacaagtgctgccacggtcaagcagctcatcacaaggctgaagttccagagagtggcgatgtcatgattgagaagaagctctacgcttcttaa

SEQ ID NO: 1052 - DNA, 585 bp, Glycine max
atgtgtggcggagcaatcatcgcagatttcatacctcggcagcgtccccgcaccctcacagcctccgaactctggcccaagcgcagcgaacctcaacctcaacctcctcctcctccagttaagaggcagaggaaaaacctctacagagggatcaggcagcggccctggggcaaatgggccgcggagattcgcgatccacgtaaaggagttcgtgtctggcttggcaccttcaacaccgccgaagaagccgccagagcctacgacaaagaagcccgaaaaatccgcggcaagaaagccaaagtcaatttccccaacgaggacgaccctctgccgcaatacggatcttgcaagagcctcaacttggagttcggttacgatctcaaccaaacagggcttttcccttcttctaacgctgatgagaattgcgggtcccacgtggcttactccgttacggaagccaacaacaaagtagagaagctttccgaggagcttatggcgtacgagaatttaatgaggttttatcagattccggaaaacgtcgttggggatttgtgggcctttcctgacacctctccacctctctga

SEQ ID NO: 1053 - DNA, 1547 bp, Glycine max
atgaaaacccaaagtgcttctctcctctgtctttttctctctcttgctatccttttggctagtggcactgctgcaagtgcaactccaagaagcgcagtgccaagccaccatgtttcaacattcaacagaagcctttttccttccacttttctctttggaattggttcttctgcttaccaggcagaaggagcagcaagtgtagatgggagaggaccaagcatatgggacacctacactagacagcatactgaaaagatttgggatcatagcaccggtgacatgggagctgatttttatcatcgatacaagggtgacataaaaatagcgaaagaaattgggctggactctttcagattctctatctcatggtcaagaatattcccaaagggcaagggagcagttaacccccttggggttaaattctacaacaatgtcatcgatgagatcctagcaaatggtttaaaaccttttgtcactctttttcattgggactttccacaagctcttgaagatgagtatggaggattccgtagtcctaaagtagtggcggattttcgtggctacgcaaacttctgcttcaagacctttggagacagagtcaaatattgggtcactttgaatgaacccttatcatttagtctcaatggctacaatggtggcacctttgcaccaggtagatgttctaaatacgttgccaattgtagtgctggcgattcatccactgaaccctatatcgttggacactacttattacttgctcatgaatctgctgccacattatacaagacaaaatatcaggctcgtcaaaaaggacaaattgggatcactaatccaacacactactttttgccaaaatctcaaagtgctgcagattacaaggcagcaagtagagctctggacttcttctttggttggtattctgatccggttttctatggtgactatccggagagtatgaaatcttcagtaggttctaggctcccaaaattcacaaaagctgaatctgaaggtctaaaaaattccatagattttcttggtgtgaattactacaccacttattatgcggaacatgctgaacctgtcagtgccaaccgaaccttctacacagacatactagccagtctcagtacggaaaggaatggtctacatgttggaaccccgactgatttgaattggctctttatctttccaaagggaattcatcttcttatggcacacataaaggataaatacaagaatcttcctatttacatcactgaaaatggcatggctgaatcaaggaatgactcaataccagtcaatgaagcccgcaaggatagtataaggattagataccatgatggccatcttaaattccttcttcaagcgatcaaggaaggtgttaatttgaagggctattatgcatggtcattttcggacagttttgaatgggatgctggttacacagttcgattcgggctcatatatgtggattacaagaacaacttgaaaagataccccaagttctctgctttttggttgcaaaagttccttctcaagtgatctga

SEQ ID NO: 1054 - DNA, 1449 bp, Glycine max
atgcccactttttttcttccaacgctcctcctccttctcatagccttcgccacctctgtctccggccgccgtgacctcgtcggagactttctccggctgccctccgaaactgataacgacgacaacttcaagggcacccggtgggccgtcctcctcgccggttccaatggttactggaattacagacatcaggctgatgtttgtcacgcctatcaaatattgaggaaaggtggtctgaaagaagaaaatattattgtttttatgtatgatgacattgcattcaatggggaaaacccaaggcctggagtcatcattaacaaaccagatggaggtgatgtttataaaggagttccaaaggattacaccggcgaagatgttactgttgataacttttttgctgctttacttggaaataagtcagcactgactggtggcagtgggaaggttgtggacagtggtcctgatgatcatatatttgtatactatactgaccatggaggtcctggggtgctcgggatgcctgctggtccttacttatacgcggatgatctgattgaagtcttgaagaaaaagcatgcttctggaacatataaaaacctagtattttatctggaggcatgtgaatctgggagtatctttgaaggtcttcttcctgaagatatcaatatttatgcaaccactgcttccaatgcagaagaaagtagttggggaacatattgccccggggagtatcctagtcctcccccagaatatacaacctgtttgggtgacttgtacagtgttgcttggatggaagacagtgacagacacaatttgcgaacagaaactctgcaccaacaatataaattggttaaagagaggactatatctggagattcatactatggctctcacgtgatgcagtatggtgatgtagggcttagcagagatgttctcttccattatttgggtacagatcctgctaatgataatttcacttttgtggatgaaaactccttatggtcaccttcaaaaccagtcaaccaacgtgatgctgatctcatccatttttgggataagttccgcaaagctcctgagggttctctcaggaaaaatacagctcagaaacaagttttggaagcaatgtctcacagaatgcatgtagacaacagtgtaaaactgattgggaagcttttatttggcattgaaaagggtccagaagtactcaacgctgttagaccggctggatcggcacttgttgatgactggcactgcctgaaaaccatggtgaggacttttgagacacattgtggatccttgtctcaatacgggatgaaacacatgaggtcctttgcaaacatctgcaatgtagggataaagaatgaacaaatggctgaggcttcagcacaagcttgtgtcagtattccttccaatccctggagttctctgcaaaggggtttcagtgcataa

SEQ ID NO: 1055 - DNA, 1488 bp, Glycine max
atggcggttgatcgctcccttacgaggtgctgtagcctcgtactgtggtcgtggatgttgctgaggatgatgatggcgcagggtgcagccgcgagggccaaccggaaggagtgggactcggtcataaagttaccggctgaaccggtcgatgctgactcggatcatgaagtgggaacacgatgggcggttcttgtggctggttcaaacggctatggaaactacaggcatcaagcagatgtgtgccatgcgtaccagttgctgataaaaggtgggctaaaagaagagaacatagtggtgtttatgtacgatgacatagctacagacgagttaaatcccagacctggagtcatcatcaaccaccctgagggacaagatgtgtatgctggtgttcctaaggattacaccggtgagaatgtgacggcccagaacctctttgccgttattcttggagacaagaataaagtgaagggaggaagtggcaaagtgatcaatagcaaacctgaggacagaatatttatatactactctgatcatggaggtccgggagttcttgggatgccaaacatgccatacctttatgctatggactttattgaagtcttgaagaagaaacatgcatctggaggttacaagaagatggtcatatacgtggaagcttgtgaaagtgggagcatgtttgagggtataatgcctaaggatctgcagatttatgtcacaactgcatccaatgcacaagagaatagttggggaacttattgtcctggaatggatccttctccacctccagagtacatcacttgcctaggggatttgtacagtgttgcttggatggaagatagtgagactcataatctaaaaagggagtccgtgaaacaacaatacaaatcggtaaagcaacggacttcaaatttcaacaactatgcgatgggttctcatgtgatgcaatacggtgacacaaacatcacagctgaaaagctttatttataccaaggttttgatcctgccgctgtgaacttccctccacagaacggaaggctagaaactaaaatggaagttgttaaccaaagagatgcagaacttttcttcatgtggcaaatgtatcagagatcaaaccatcagccagaaaagaagacagacatcctcaaacagatagcggagacagtgaagcataggaaacacatagatggtagcgtggaattgattggagttttattgtatggaccaggaaaaggttcttctgttctacaatccatgagggctcctggtcttgcccttgttgatgactggacatgcctaaaatcaatggttcgggtgtttgagactcactgtgggacactgactcagtatggcatgaaacacatgcgagcatttgccaacatttgcaacagcggtgtttctgaggcctccatggaagaggtttgtgtggcagcttgtgaaggctacgattctgggctattacatccatcaaacaaaggctatagtgcttga

SEQ ID NO: 1056 - DNA, 843 bp, Glycine max
atggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaaacttttcaaaattgggagagcaggtgaaagcagtagaattggctggttgtgattggattcacgttgatgtaatggatggtcgctttgttccaaatattacaattggacctcttgtggttgatgcattgcgccctgtgacagatcttcctttggatgtacacctgatgattgtagagcctgaacaaagggtaccagattttattaaggcaggagctgatatagtcagtgttcattgtgaacaatcttccaccatccatttgcatcgtacagttaatcaagtgaaaagtctgggagctaaagctggagttgtcttaaaccccggtacccccttaagtgcaatagaatatatccttgatgtggttgatttggtcttaattatgtccgtaaaccctggctttggtggccagagttttattgagagtcaagtaaagaaaatttctgatttgagaagattgtgtgcggagaagggagtgaatccatggattgaagtagatggtggagttggtccagcaaatgcatacaaggtgattgaggctggagccaatgcactggttgctggctctgctgtttttggagctaaagattatgccgaagctataagaggaatcaaaaccagcaaaagacctgaagtagttgctgtgtga

SEQ ID NO: 1057 - DNA, 1332 bp, Glycine max
atgggaaaaggaaacatggaactcgagacaaacaaggtctatgactacgaggatgcacgaggggacgttgaagtcccagataccgctcatcagataagcactgattcatggtttcaagtggcttttatcctcacaaccggaatcaacagtgcctttgttcttggatatccagggaccgtcatggttcccctgggttggatcgggggtgtgattggtctaattcttgctaccatggtgtcactctatgcaaatgctctaattgcttatctccatgaattaggaggccaaaggcacattaggtatagagatcttgctggatttatatacggtaagaaagcgtataatctcacatgggttctgcagtatatcaatcttttcatgataaatactggctacatcattttggccggttcagccttgaaagctacttatgttctattcagggatgatgggctgctgaaacttccatattgtattgccataggtggatttgtgtgtgcaatgtttgccatctgcattcctcatctttcagctctgggaatttggctaggattttcaacagtcttcagcctggcatatattgttatatcatttgtgttgtcgcttaaagatggattacaatcaccgcctcgagattacgagattccaggagatggtgtaagcaaaatctttacaataattggagcatctgctaaccttgtgtttgcatttaataccggcatgcttcctgagatacaggcaacaattaggcaaccagttgttaagaacatgatgaaagccttgtactttcagtttaccgttggagttctaccattgtacctggttgcctttacaggatactgggcttatggatcttccacagaagtgtatttgctgaatagtgtgaatggtccagtttgggtgaaggcttctgccaacatcacagcctttcttcaatcagtcattgcattgcatatttttgcaagtccaatgtacgagtttttggatactaaatatgggatcaaaggaagtgcactgaatgctaaaaacttgtcattccgagtcgtggtaagaggtggctacctagcctttaacacatttgtggcggctttcctgccattccttggagatttcatgagcctcacaggggcgatcagcacatttccccttacgtttattcttgcaaaccacatgtaccttaaggcaaagaaggacaaactaaacagctcacaaaagctctggcaccggttcaatattggtttctttgccattatgtctctggcagcaacaatttcagccatacggctcatttctgtagactccaaaacataccatgtttttgctgatttgtga

SEQ ID NO: 1058 - DNA, 681 bp, Glycine max
atggccacaccagcatccatcaccaatgtcactgtggagttccttcaattccccgcggtggtgacacctcctgcctctaccaaatcctatttccttggtggcgcaggggtgagagggttgaatattgaagaagaatttgtaaagttcacgggaataggtgtttatttggaagacaaggccgtgtcatcactcggtgccaaatggaagggcaaaagtgcagctgaattgctggactcacttgacttctacagagatatcatcaaaggtccgtttgagaagttaattcgagggtcaaagttaagaacattggatggtcgtgaatacgtaaggaaggtgtcagagaactgtgtggcccatatggaatccgttgggacttacagtgaagcagaagaaaaagctattgaggaatttagaaatgctttcaaggatcaaaatttcccaccaggctccactgttttctacaaacaatcacccactggaacattggggcttagtttctcgaaagatgagacaataccagaacatgagcatgcagtgatagacaacaaaccactctcggaggccgttctggagactatgatcggagagattcctgtttcccctgctttaaaagagagtttggctacaaggtttcaccagtttttcaaagagttagaggccaatcccaacaatgaaaactga

SEQ ID NO: 1059 - DNA, 726 bp, Glycine max
atggaagtagacaccgagaagaagcaacaagacgtggtgaaagagaaggacttattcaaagccgctgaagagggtgacatgtcaacgttcgaagcacactcctctgaaaccctctccaaagccctctctctcagaaacgaagacgctcgctccctcctccacgttgcagcttcttccggccactcccaggtagtgaagatgctattgtcttgtgatgcgtctgttggtgtggtgaattgtgccgacgaggaagggtgggcgccgcttcactctgcagccagcattgggagtgtggagatagtggagactctattgagcaaaggagctgatgttaacctgaaaaataatgggggccgcactgctctacactatgctgccagcaaaggttgggtgaagatcgctgaaatgctcatctcccatgatgccaagattaatataaaggataaggttggttgcactccattgcatcgggcagctagcactgggaaatctgagctgtgtgaatttttgattgaagaaggagcagaggttgatgctgttgatagagctggtcaaactcctctaatgaatgctgtgatttgctataacaaagaggtagcccttcttctgataagacatggagcagatgtggatgtggaggacaaggaagggtacacagtgcttggtcgagccacacatgagtttagaccaatattaattgatgctgccaaggccatgcttgagtga

SEQ ID NO: 1060 - DNA, 1488 bp, Glycine max
atggagaagaagaagggtgagctaaagtcaattttccttcctttcctttccactagtcacataatcccgctagtggacatggccagactcttcgccttgcacgacgtcgacgtcaccatcatcaccaccgcacataacgccaccgttttccaaaagtccatcgatttagatgcgagtcgcggtcgccccatcagaacgcacgttgtcaacttccccgccgcacaagtgggtctccccgttgggatcgaagccttcaacgtcgatacgcctcgggaaatgacccccagaatctacatgggcctatcccttctccaacaagtcttcgaaaaactcttccatgacttgcaaccggatttcatcgtcaccgacatgttccacccttggagtgtcgatgctgctgctaaactcggcattccgaggatcatgttccacggcgcaagttatctcgctcgctccgctgcgcactccgttgaacagtacgcaccccacttggaagcaaaattcgacaccgacaagttcgtgttacctgggttacccgataacttggagatgacgcgcttgcagttgccggattggcttaggtctccgaatcagtacactgaactgatgaggacgattaagcagtcagagaaaaagagttacggttcactttttaatagtttttatgacctcgagagtgcttactacgagcattacaagagcatcatgggaactaagagttggggaattggaccggtttcgttgtgggcgaaccaggatgctcaagataaagctgcacgagggtatgctaaagaagaagaagagaaagaagggtggcttaagtggctcaactccaaagcagagagctctgttttgtatgtgagttttgggagcatgaacaagttcccttactctcagctcgttgaaatagcacgtgcgcttgaagattcggggcatgattttatctgggtggtgaggaaaaacgatgggggtgaaggagataactttttggaggagtttgagaagagaatgaaggaaagtaacaaaggatatttaatatggggttgggccccacagttgttgatactggagaatcctgcgattggagggttggttactcactgtggttggaacacggtggtggaaagcgtgaacgcggggttgccgatggcgacgtggcctctgtttgcggagcattttttcaacgagaagctggtggtggatgtgttgaagattggggtgccggtgggggcgaaagagtggaggaactggaacgagtttgggagtgaggtggtgaaacgggaggagattggaaacgcgattgcttcgttgatgagtgaggaagaagaagatggaggaatgaggaagagagccaaggagctaagcgttgcggcgaagagtgctataaaggttggtggatcttcgcacaacaacatgaaggaattgattcgggagctcaaggagatcaagctttccaaggaggctcaagagaccgcacccaatccttaa

SEQ ID NO: 1061 - DNA, 381 bp, Glycine max
atgaggtttggggcaattgcattcgttttgatgctagcattttgctgttgtacgggttcagatagatggagaaacatagaggtcaaaatgcatggaaaaaacaaacaagttagcagcgagaataatgatcatcattcaatccctcttaaagactatggtaaacctggctcaggccaccatgacgttactgcagcagatgataacaatgatcatcattacatccctcgcaaggattttggtaaacatggctctgcccaatttcatgtcactgatgatcataataggtaccattgcgtccataatagtaattataaggaagatcgtacttgttatggccaacctggcggaggaattaaagttaatcccgggcccgggcattga

SEQ ID NO: 1062 - DNA, 267 bp, Glycine max
atgggtcagatccagtactccgagaagtacttcgatgacacttacgaatatagacatgtggttcttcctcctgaagtcgcaaaactgcttcccaagaatcgtcttctctccgaaaatgagtggcgggcaattggggttcagcagagccgtggctgggttcattatgcaattcatcgccctgagccacacataatgctcttcaggaggcctttgaattatcagcagcagcaggaaaaccaggcccagcaaagcatgcttgtcaaatga

SEQ ID NO: 1063 - DNA, 2318 bp, Artificial
  AT 6669 (NEW) promoter sequence
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

The invention claimed is:

1. A method of controlling a cyst nematode plant pest, comprising contacting the cyst nematode plant pest with a transgenic plant, or part thereof, having incorporated into its genome a recombinant nucleic acid molecule comprising a nucleic acid sequence encoding SEQ ID NO: 250, or encoding a conservatively modified variant of having at least 95% sequence identity to SEQ ID NO: 250, thereby controlling the cyst nematode plant pest.

2. The method of claim 1, wherein said nucleic acid sequence is operatively linked to a promoter functional in a plant or plant cell, and wherein said nucleic acid sequence is SEQ ID NO: 232.

3. The method of claim 1, wherein said polypeptide is a conservatively modified variant having at least 98% sequence identity to SEQ ID NO: 250.

4. The method of claim 1, wherein said polypeptide is set forth by SEQ ID NO: 250.

5. The method of any one of claim 1, wherein the transgenic plant or plant part is a transgenic soybean plant, a transgenic sugar beet plant, a transgenic corn plant, a transgenic canola plant, a transgenic wheat plant, or a transgenic rice plant, or a part thereof.

6. The method of claim 1, wherein said cyst nematode is a soybean cyst nematode or a sugar beet cyst nematode.

7. A transgenic plant, or part thereof, having incorporated into its genome a recombinant nucleic acid molecule comprising a nucleic acid sequence encoding a polypeptide selected from the group consisting of SEQ ID NOs: 250, 1019, 1021, 1022, 1023, and 1024, or a conservatively modified variant of said polypeptide having at least 95% sequence identity to said polypeptide, wherein the transgenic plant is resistant to a cyst nematode pest.

8. A seed from the transgenic plant of claim 7, wherein said seed comprises said recombinant nucleic acid molecule.

9. The transgenic plant of claim 7, wherein the plant is a transgenic soybean plant, a transgenic sugar beet plant, a transgenic corn plant, a transgenic canola plant, a transgenic sugar cane plant, a transgenic wheat plant, or a transgenic rice plant.

10. A method of producing a transgenic plant, the method comprising introducing into a plant a recombinant nucleic acid molecule comprising a nucleotide sequence operatively linked to a promoter functional in a plant, wherein said nucleotide sequence encodes the polypeptide set forth by SEQ ID NO: 250, or a conservatively modified variant having at least 95% sequence identity to SEQ ID NO: 250, thereby producing a transgenic plant having increased resistance to a cyst nematode plant pest.

11. The method of claim 10, wherein the introducing is done by transforming a plant cell and regenerating a transgenic plant or by breeding.

12. The method of claim 10, wherein the cyst nematode plant pest is selected from the group consisting of: a soybean cyst nematode and a sugar beet cyst nematode.

13. A transgenic plant having increased resistance to a cyst nematode plant pest produced by the method of claim 10.

14. The transgenic plant of claim 10, wherein the transgenic plant is a transgenic soybean plant, a transgenic sugar beet plant, a transgenic corn plant, a transgenic canola plant, a transgenic wheat plant, or a transgenic rice plant.

15. A method of reducing the infectivity of a cyst nematode plant pest to a plant, comprising contacting the cyst nematode plant pest with the transgenic plant of claim 7, thereby reducing the infectivity of the cyst nematode plant pest to the plant.

16. A method of reducing nematode cyst development by a cyst nematode plant pest, comprising contacting the cyst nematode plant pest with the transgenic plant of claim 7, wherein nematode cyst development by the cyst nematode plant pest on the roots of the plant is reduced.

17. A method of reducing the growth of a cyst nematode plant pest population, comprising contacting the cyst nematode plant pest population with the transgenic plant of claim 7, wherein the growth of a cyst nematode plant pest population is reduced.

18. A method of producing a soybean plant having increased resistance to infestation by a cyst nematode plant pest, the method comprising the steps of (a) crossing the transgenic plant of claim 7 with itself or another plant to produce seed comprising said recombinant nucleic acid molecule (b) growing a progeny plant from said seed to produce a plant having increased resistance to infestation by cyst nematode plant pests.

19. The method of claim 18, further comprising (c) crossing the progeny plant with itself or another plant and (d) repeating steps (b) and (c) for an additional 0- 7 generations to produce a plant having increased resistance to infestation by cyst nematode plant pests.

20. A crop comprising a plurality of the transgenic plants of claim 7 planted together in an agricultural field.

21. A method of improving yield of a plant crop, comprising: cultivating a plurality of the plants of claim 7 as a plant crop, wherein the plurality of plants of said plant crop have increased resistance to cyst nematode infection, thereby improving the yield of said plant crop.

22. The method of claim 1, wherein said cyst nematode is a soybean cyst nematode (*Heterodera glycines*).

23. The transgenic plant of claim 7, wherein said cyst nematode is a soybean cyst nematode (*Heterodera glycines*).

24. The method of claim 10, wherein said cyst nematode is a soybean cyst nematode (*Heterodera glycines*).

25. The transgenic plant of claim 13, wherein said cyst nematode is a soybean cyst nematode (*Heterodera glycines*).

26. The method of claim 15, wherein said cyst nematode is a soybean cyst nematode (*Heterodera glycines*).

27. The method of claim 16, wherein said cyst nematode is a soybean cyst nematode (*Heterodera glycines*).

28. The method of claim 17, wherein said cyst nematode is a soybean cyst nematode (*Heterodera glycines*).

29. The method of claim 18, wherein said cyst nematode is a soybean cyst nematode (*Heterodera glycines*).

30. The transgenic plant of claim 7, wherein said polypeptide is a conservatively modified variant having at least 98% sequence identity to SEQ ID NO: 250.

31. The transgenic plant of claim 7, wherein said polypeptide is set forth by SEQ ID NO: 250.

32. The method of claim 10, wherein said nucleotide sequence encodes the polypeptide set forth by SEQ ID NO: 250.

\* \* \* \* \*